United States Patent 11,098,302 (IDENTIFICATION OF POLYNUCLEOTIDES ASSOCIATED WITH A SAMPLE) - sequence listing, part 44

SEQ ID NO: 149037 - DNA, 869 bp, Homo sapiens
  misc_feature: GYAE6OF02HETAX.10.63.F08.1.454.CMB.1.raw
tcagcatagtagtgcacgaccggtgctcgatttagcgatcgtataagggggaggaactgctcagttaggacccagagggaaccatggaacgccccagctcagcttctcttcctcctgctactctggctcccaagaaactaccgcaagaaattgtgttgacactagtctaccagacccaccttgttctttgtcctaccggaagggggaaaacacgccctaacccctctaccgtgaccgacgggacctagtcaaggtcgttcgtttccccgattaacttacgccgtacggtaacccaaacgagaacgtccgtacggaccgaccggtccgtacccgacggtccctacctcgtaagttacgtaagtcggaattcgacctacaccaaacggacggtaccacgtaccggacctaaccgtccccgaaggtcccgttaaggttacggtacgtacggacgtacggttcggggttacctcggaaccgaacgtaactacgttacctacgttccctaaccgaactacgaacctaaccgacgtaacccgttaacggtaaaccgtacgtaaacgtttctttacgtacttttaaccgttttacgtttacgtacgttaccgaaacgttaccgtaacggtacgtaaccgtaccggtaaccggttcccgttaacccgggtaccggttccgggtaacccgggggttaaaccgggaaaaccggggtaaaccgggttaggggtaaacggtaacccgttacgggtaaaccggaaccgggttaacggtcccggttagggtacccggtaacggtaacccgtaaccggtaacctttacccggtttacgggttaccttacccggtttaaccttcccccggttaaccccgtttccg

SEQ ID NO: 149038 - DNA, 639 bp, Homo sapiens
  misc_feature: GYAE6OF02FJA1S.10.63.F08.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgtttcccgntactagcctggtaccaacagaagcctggccaggctcccaggctcctcatgtatgatgcactccaacgacgggccacgtggcactccccagcccaggtttcaggttcggcacggttggggtctggccgtacacgtacctttcacttcgtaccacctactaccaaacacgaccctaagaacctgaagttacttttgaccttaacttttactttactacgttaccaaccgtaggtacgttccgacgtaaaccgttcggacccttacccggtacggtttccggacccgtaacgggggaccgtaaggggtcggaacgtacgtacgaacggtacggaacgtcggtcggtacctacggacctacccgtagttccttcggttacctttaccgtacttcccgttcccgtaacc

SEQ ID NO: 149039 - DNA, 803 bp, Homo sapiens
  misc_feature: GYAE6OF02H30KN.10.63.F08.1.454.CMB.1.raw
  modified_base (493)..(493): a, c, t, g, unknown or other
  misc_feature (493)..(493): n is a, c, g, or t
tcagcatagtagtgcacgaccggtgctcgatttagcgatcgtataagggggaggaactgctcagttaggacccagagggaaccatggaagcccagctcagcttctcttcctcctgctactctggctccagaaactaccgcagaaattgtgttgacacagtctccagccacctgttcttcgtcctccgaaagggggtaaacacgcccacccttctccgtggaccgacggggaccctaaggtccgaagggtacggtttccgttttccccgactttaaacgtttacggtcccttagggtaaacccaaagaacgggaacgtcccgtcgggaccaacgggtcccctacccgtaagggtccctaccccgttagtaagttacggtacgttaaggacttcggacctaacgttaccccgaaaacggtcggaccctacgtcggaccaaccgtcccgaacggtccgtaagggtttccaagggttcgcgtaggttccgggttacncggaccgaactacggttcctacgactcaccacactacgacgacacgtaacgtaccgtaagtaacgtattcgtacttactttatttcgtacgtaccgtaaccgagtacgaccgttacgaacgtccggtaccctccggttaccggttaccggacccgggtaacgggtaaccggtaacggttacgggacgtaacgttaccgaacgtaacccggtaagttccggtaaggtacccgttaggaacccgttaaccgtaccgttttccgtacggtttacccgtttaccgttaacccgtttcccgttacccgttacccg

SEQ ID NO: 149040 - DNA, 758 bp, Homo sapiens
  misc_feature: GYAE6OF02H2UB4.10.63.F08.1.454.CMB.1.raw
  modified_base (750)..(750): a, c, t, g, unknown or other
  misc_feature (750)..(750): n is a, c, g, or t
tcagcatagtagtgcacgaccggtgctcgatttagcgatcgtataagggggaggaactgctcagttaggaccagagggaaccatggaagccccagctcagcttctcttcctcctgctactctggctcccagaaactaccgcaggaaattgtgttagacacagtctccagccacctgttctttgcctacgagggaagcgccaccctctctgcgagggccagtcagtacgttcgtttccgctacgttacgccgtaggtaccaacgagtaacgccgtacggacccgaggtcctacccgacggttcctaccgtctagttacggttactaggtaacgttacgttaccgttttaaccgaaccgggtacccggggtaccccgttcgggtacccgtacccggtacgggtaccgttcgggttaccgaggttcggacggtggtacggtcggtacggactacggttacctacgtacctcgtaccgaactacgtacgacgacgtacgaccgtaggaccgtacgtacgtaacgtttacgtttacgtaactttagtttagttaccgtgtccgtaacgcgtacgtcgttaccggtacgtttaccgggttgggacggttcggtacgtccgttaaccgggtaggaaccgggtaacgtaaacgttaaaggacggttaacgtaaacgtaacggtacggttagtccgggtaactacggtaacctgttaaccgttcgtttcttacggttaaccttcggttacccgttaccnttaaccgg

SEQ ID NO: 149041 - DNA, 818 bp, Homo sapiens
  misc_feature: GYAE6OF02HDSF6.10.63.F08.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
tcagcatagtagtgcacgaccggtgctcgatttagcgatcgtataagggggaggaactgctcagttaggacccagagggaaccatggaagccccagctcagcttctcttcctctgctactctggcctccagaactaccgcaagaattgtgttgacacagtctccaacgccaccctntctttcgtctaccgaggggaanacgcccaccctctcctcgcgacgggccagtcgagtagttcgtttccccgacttaccgtttagcccttaggtaacccaagacggaacgtccgtagggaccctaggcccgtcccgacggtcctaccctcgaattcggtagttgacgttnaccgtaacttacccgaaagacccggggtccaacgttcggaacctaccgtaccaacggccgtaaggttaccgaagggtcggtcctaaggtcgggtcttcgggacgaacctaagtacgtttctacgtcctaccgtaaccaagtcctaaagaccgtaccgtacgtaaacgtaaggtaaaggttcgtttacgtactttaacgtttacgttacgttacgtaccgacggttaacgttacgaccgtcccgtaaaccgtcggtacccgttaccgggttacccggtttcggggaaccccgggtaacgggttaacccggtaaaaccggttacgggttaaacgaccgtaaacccgggtagggttaacccgaaaggggtttaccccggaaggttaccgtaaccggtaccccggtaaccgttaacgttcccgtttacggtttacccttacggttaaccccgtttcccggtacccccgtttaaccgg

SEQ ID NO: 149042 - DNA, 420 bp, Homo sapiens
  misc_feature: GYAE6OF01EZ1RA.42.41.D08.1.454.CMB.1.raw
  modified_base (221)..(221): a, c, t, g, unknown or other
  misc_feature (221)..(221): n is a, c, g, or t
  modified_base (416)..(420): a, c, t, g, unknown or other
  misc_feature (416)..(420): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaaagntctgggcggtacaggttcgtttgactactggggtcagggaaccctggtcaccgtctcctcagcctccaccaagggccatcggtcttccccctggcgccctgctccaggagcacctccgagagcacagcggccctgggctgcctggtcaagactacttccacatacgtcactgagcgggctggcaaggcgcatagnnnnn

SEQ ID NO: 149043 - DNA, 416 bp, Homo sapiens
  misc_feature: GYAE6OF01D09QC.42.41.D08.1.454.CMB.1.raw
  modified_base (409)..(409): a, c, t, g, unknown or other
  misc_feature (409)..(409): n is a, c, g, or t
  modified_base (415)..(416): a, c, t, g, unknown or other
  misc_feature (415)..(416): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaagatctgggcgtacaggttcgtttgactactggggtcagggaaccctggtcaccgtctcctcagcctccaccaaggccatcggtcttcccctggcgccctgctccaggagcacctccgagagcacagccggccctgggctgcctggtcaaggctactccacatacgtcactgagcgggctggcaaggcncatagnn

SEQ ID NO: 149044 - DNA, 446 bp, Homo sapiens
  misc_feature: GYAE6OF01ETGG6.42.41.D08.1.454.CMB.1.raw
  modified_base (233)..(233): a, c, t, g, unknown or other
  misc_feature (233)..(233): n is a, c, g, or t
  modified_base (425)..(446): a, c, t, g, unknown or other
  misc_feature (425)..(446): n is a, c, g, or t
tcagtgacgtatgtcacgaccggtgctcgatttagtcacgcgagaaagggaaaggggctgggtgtggggtctccacgcgttcgttattggtgatgggtagtaacacaagatacggggactccgtgaagggccgattcagcatctccagtaggacaacgccaagactacgttgtatctggtaaatgaacaatctgggagccgaggacacggctgtctatttcgtgtgtaaaagntctgggcgggtacaggttcgtttgactactggggtcagggaccctggtcaccgtctcctcagcctccacaggccatcggcttcccctggccgccctgctccaggagcacctccgagagcacagcggccctgggctgcctggtcaaggactacttccacataccgtcactgagcggctggcaaggcgcatagnnnnnnnnnnnnnnnnnnnnnn

SEQ ID NO: 149045 - DNA, 424 bp, Homo sapiens
  misc_feature: GYAE6OF01AUWJF.42.41.D08.1.454.CMB.1.raw
  modified_base (417)..(424): a, c, t, g, unknown or other
  misc_feature (417)..(424): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttcgtgtgtaaaagatctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaaggcgcatagnnnnnnnn

SEQ ID NO: 149046 - DNA, 422 bp, Homo sapiens
  misc_feature: GYAE6OF01DDDSL.42.41.D08.1.454.CMB.1.raw
  modified_base (221)..(221): a, c, t, g, unknown or other
  misc_feature (221)..(221): n is a, c, g, or t
  modified_base (418)..(422): a, c, t, g, unknown or other
  misc_feature (418)..(422): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctggggcggtacaggttcgtttgactactggggtcagggaaccctggtccaccgtctcctcagcctccaccaagggcccatcggtctccccctggcgccctgctccaggacgcacctccgagagcacagcggccctgggctgcctggtcaaggctactccacatacgtcactgagcgggctggcaaggcgcatagnnnnn

SEQ ID NO: 149047 - DNA, 426 bp, Homo sapiens
  misc_feature: GYAE6OF01CKCE3.42.41.D08.1.454.CMB.1.raw
  modified_base (418)..(426): a, c, t, g, unknown or other
  misc_feature (418)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcgtacaggttcgtttgactactggggtcagggaaccctggtcaccgtctcctcagcctccaccaagggcccatcggtcttcccctggcgccctgctccaggagcacctccgagagcacagcggccctgggcctgcctggtcaaggactacttccacatacgtcactgaggcgggctggcaaggcgcatagnnnnnnnnn

SEQ ID NO: 149048 - DNA, 421 bp, Homo sapiens
  misc_feature: GYAE6OF01A8KWW.42.41.D08.1.454.CMB.1.raw
  modified_base (220)..(220): a, c, t, g, unknown or other
  misc_feature (220)..(220): n is a, c, g, or t
  modified_base (416)..(421): a, c, t, g, unknown or other
  misc_feature (416)..(421): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctaccttccacatacgtcactgagcgggctggcaaggcgcatagnnnnnn

SEQ ID NO: 149049 - DNA, 422 bp, Homo sapiens
  misc_feature: GYAE6OF01B2GRV.42.41.D08.1.454.CMB.1.raw
  modified_base (220)..(220): a, c, t, g, unknown or other
  misc_feature (220)..(220): n is a, c, g, or t
  modified_base (411)..(411): a, c, t, g, unknown or other
  misc_feature (411)..(411): n is a, c, g, or t
  modified_base (416)..(422): a, c, t, g, unknown or other
  misc_feature (416)..(422): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtcaccgtctcctcagcctccaccaagggcccatcggtctccccctggccgccctgctccaggagcacctccgagagcacagcgccctgggctgcctggtcaaggctacttccacatacgtcactgagcgggctggcaaggcgnatagnnnnnnn

SEQ ID NO: 149050 - DNA, 426 bp, Homo sapiens
  misc_feature: GYAE6OF01AH9DN.42.41.D08.1.454.CMB.1.raw
  modified_base (221)..(221): a, c, t, g, unknown or other
  misc_feature (221)..(221): n is a, c, g, or t
  modified_base (386)..(386): a, c, t, g, unknown or other
  misc_feature (386)..(386): n is a, c, g, or t
  modified_base (420)..(426): a, c, t, g, unknown or other
  misc_feature (420)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactactggggtcagggaaccctggtcaccgtctcctcagcctccaccaagggcccatcggtcttccccctggtcgcccctgctccaggagcacctccgagagcacagcggccctgggcctgcctggtcaaggactacttccanatacgtcactgagcgggctggcaaggcgcatagnnnnnnn

SEQ ID NO: 149051 - DNA, 438 bp, Homo sapiens
  misc_feature: GYAE6OF01DQFFA.42.41.D08.1.454.CMB.1.raw
  modified_base (223)..(223): a, c, t, g, unknown or other
  misc_feature (223)..(223): n is a, c, g, or t
  modified_base (431)..(438): a, c, t, g, unknown or other
  misc_feature (431)..(438): n is a, c, g, or t
tcagtgacgtatgtcacgaccggtgctcgatttagtcacgcgagaaagggaaaggggctggtgtgggtctcagctgttattggtgatgggagtaacacaagatatggggactccgtgaagggccgattcagcatctccagagacaacgccaagaacacgttgtatctggaaatgaacaatctgggagccgaggacacggctgtctatttctgtagtaaaaagntcgtgggcggtacaggtttcgtttgactacgtggggtcagggaaccctggtcaccgtctcctcagcctccaccaagggcccatcggtccttccccctggccgccctgcctccaggcgcacctccgagacgcacagccggccctgggctgcctggtcaaggctacttccaacatacgtcactgacggcgggctggcaaggcgctatagnnnnnnnn

SEQ ID NO: 149052 - DNA, 428 bp, Homo sapiens
  misc_feature: GYAE6OF01B7M4Z.42.41.D08.1.454.CMB.1.raw
  modified_base (223)..(223): a, c, t, g, unknown or other
  misc_feature (223)..(223): n is a, c, g, or t
  modified_base (423)..(428): a, c, t, g, unknown or other
  misc_feature (423)..(428): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaagntctggggcggtacaggttcgtttgactacgtggggtcagggaaccctggtcaccgtctcctcagcctccaccaagggcccatcggtcttccccctggccgccctgctccaggacgcacctccgagagcacagcggccctgggctgcctggtcaaggactactccacatacgtcactgagcgggctggcaaggcgcatagnnnnnn

SEQ ID NO: 149053 - DNA, 427 bp, Homo sapiens
  misc_feature: GYAE6OF01AWXJ6.42.41.D08.1.454.CMB.1.raw
  modified_base (221)..(221): a, c, t, g, unknown or other
  misc_feature (221)..(221): n is a, c, g, or t
  modified_base (421)..(427): a, c, t, g, unknown or other
  misc_feature (421)..(427): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttccccctggccgccctgctccaggagcaccctccgagagcacagcggccctgggcctgcctggtcaaggactacttccacatacgtcactgagcgggctggcaaggcgcatagnnnnnnn

SEQ ID NO: 149054 - DNA, 423 bp, Homo sapiens
  misc_feature: GYAE6OF01AX4IU.42.41.D08.1.454.CMB.1.raw
  modified_base (419)..(423): a, c, t, g, unknown or other
  misc_feature (419)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatggaacaatctgggagccgaggacacggctgtctatttctgtgtaaaagatctgggcggtacaggttcgtttgactactggggtcagggaccctggtcaccgtctcctcagcctccaccaagggcccatcggtcttccccctggccgcccctgctccaggagcacctccgagagcacagcggccctgggctgcctggtcaaggctacttccacatacgtcactgagcgggctggcaaggcgcatagnnnnn

SEQ ID NO: 149055 - DNA, 423 bp, Homo sapiens
  misc_feature: GYAE6OF01CKC4H.42.41.D08.1.454.CMB.1.raw
  modified_base (221)..(221): a, c, t, g, unknown or other
  misc_feature (221)..(221): n is a, c, g, or t
  modified_base (421)..(423): a, c, t, g, unknown or other
  misc_feature (421)..(423): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntctggggcggtacaggttcgtttgactacgtggggtcagggaaccctggtcaccgtctcctcagcctccaccaagggcccatcggtcttccccctggcgccctgctccaggacgcacctccgagagcacagcggccctgggctgcctggtcaaggactacttccacatacgtcactgagcgggctggcaaggcgcatagnnn

SEQ ID NO: 149056 - DNA, 559 bp, Homo sapiens
  misc_feature: GYAE6OF01EPRJL.42.41.D08.1.454.CMB.1.raw
  modified_base (221)..(221): a, c, t, g, unknown or other
  misc_feature (221)..(221): n is a, c, g, or t
  modified_base (492)..(493): a, c, t, g, unknown or other
  misc_feature (492)..(493): n is a, c, g, or t
  modified_base (495)..(497): a, c, t, g, unknown or other
  misc_feature (495)..(497): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (541)..(542): a, c, t, g, unknown or other
  misc_feature (541)..(542): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(559): a, c, t, g, unknown or other
  misc_feature (557)..(559): n is a, c, g, or t
tcagtgacgtatgtcacgaccggtgctcgattttagtcacgcgagaaagggaaaggggggctgggtgtaggggtcttcgaggtctgttaattcggtggattgggagttaacacaagtatacggggactccggtgaagggccgagttcacgcgatctccagagacaaccgcaagaacacgttgtactcgtggaaatgaacaagtctgggaggccgacggacncggaaactgtctaatttctgtcgtaaaagattcttgggcgtacaggttcgtttagactactagggtcagggaccttggtcaccgtctcctacacgcctccacccgaacggccactcgttccttccccgtcggccgtcccgtcggccgtccggacggcgccacctccgagacgcacgacggccggccggtggctcgtccgtcggtacaacggacctacttaccaactaactacgtcacgtcgaggcgggcgtggcgaacggcgtactatgcnnannncgctcncncncgngcgngcagngnnacganangngncnncnctnntcnctnctcncnncnnn

SEQ ID NO: 149057 - DNA, 426 bp, Homo sapiens
  misc_feature: GYAE6OF01E3DH7.42.41.D08.1.454.CMB.1.raw
  modified_base (221)..(221): a, c, t, g, unknown or other
  misc_feature (221)..(221): n is a, c, g, or t
  modified_base (420)..(426): a, c, t, g, unknown or other
  misc_feature (420)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgttgactactggggtcagggaaccctggtcaccgtctcctcagcctccaccaagggcccatcggtcttccccctggcgcccctgctccaggagcacctccgagagcacagcggccctgggctgcctggtcaagggactacgttccacatacgtcactgagcgggctggcaaggcgcatagnnnnnnn

SEQ ID NO: 149058 - DNA, 420 bp, Homo sapiens
  misc_feature: GYAE6OF01CE791.42.41.D08.1.454.CMB.1.raw
  modified_base (319)..(319): a, c, t, g, unknown or other
  misc_feature (319)..(319): n is a, c, g, or t
  modified_base (418)..(420): a, c, t, g, unknown or other
  misc_feature (418)..(420): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaagggcccatcggtcttccccctggccnccctgctccaggagccacctccgagagcacagcggccctgggctgcctggtcaaggctactccacatacgtcactgagcgggctggcaaggcgcatagnnn

SEQ ID NO: 149059 - DNA, 420 bp, Homo sapiens
  misc_feature: GYAE6OF01EY5J1.42.41.D08.1.454.CMB.1.raw
  modified_base (220)..(220): a, c, t, g, unknown or other
  misc_feature (220)..(220): n is a, c, g, or t
  modified_base (416)..(420): a, c, t, g, unknown or other
  misc_feature (416)..(420): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaaggcgcatagnnnnn

SEQ ID NO: 149060 - DNA, 421 bp, Homo sapiens
  misc_feature: GYAE6OF01A0QX7.42.41.D08.1.454.CMB.1.raw
  modified_base (221)..(221): a, c, t, g, unknown or other
  misc_feature (221)..(221): n is a, c, g, or t
  modified_base (417)..(421): a, c, t, g, unknown or other
  misc_feature (417)..(421): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaaggcgcatagnnnnn

SEQ ID NO: 149061 - DNA, 426 bp, Homo sapiens
  misc_feature: GYAE6OF01BTHDT.42.41.D08.1.454.CMB.1.raw
  modified_base (221)..(221): a, c, t, g, unknown or other
  misc_feature (221)..(221): n is a, c, g, or t
  modified_base (420)..(426): a, c, t, g, unknown or other
  misc_feature (420)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtcaccgtctcctcagcctccaccaagggcccatcggtcttccccctggcgcccctgctccaggagcacctccgagagcacagcggccctgggctgcctggtcaaggactacttccacatacgtcactgagcgggctggcaaggcgcatagnnnnnnn

SEQ ID NO: 149062 - DNA, 424 bp, Homo sapiens
  misc_feature: GYAE6OF01ARALM.42.41.D08.1.454.CMB.1.raw
  modified_base (419)..(424): a, c, t, g, unknown or other
  misc_feature (419)..(424): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactgggggtcaggggaaccctggtcaccgtctcctcagcctccaccaagggcccatcggtcttccccctggccgccctgctccaggagcacctccgagagcacagcggccctgggctgcctggtcaaggctacttccacatacgtcactgagcgggctggcaaggcgcatagnnnnnn

SEQ ID NO: 149063 - DNA, 429 bp, Homo sapiens
  misc_feature: GYAE6OF01BATDS.42.41.D08.1.454.CMB.1.raw
  modified_base (221)..(221): a, c, t, g, unknown or other
  misc_feature (221)..(221): n is a, c, g, or t
  modified_base (417)..(417): a, c, t, g, unknown or other
  misc_feature (417)..(417): n is a, c, g, or t
  modified_base (423)..(429): a, c, t, g, unknown or other
  misc_feature (423)..(429): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcggtacaggtttcgtttgactacgtggggtcagggaaccctggtcaccgtctcctcagcctccaccaagggcccatcggtcttccccctggccgcccctgcctccaggagcacctccgagagcacagcggccctgggctgcctggtcaaggctactccacatacgtcactgagcgggctggcaaggcgnagtagnnnnnnn

SEQ ID NO: 149064 - DNA, 420 bp, Homo sapiens
  misc_feature: GYAE6OF01B1YAX.42.41.D08.1.454.CMB.1.raw
  modified_base (221)..(221): a, c, t, g, unknown or other
  misc_feature (221)..(221): n is a, c, g, or t
  modified_base (316)..(316): a, c, t, g, unknown or other
  misc_feature (316)..(316): n is a, c, g, or t
  modified_base (414)..(420): a, c, t, g, unknown or other
  misc_feature (414)..(420): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcgtacaggttcgtttgactacgtggggtcagggaccctggtcaccgtctcctcagcctccaccaaggcccatcggtcttcccctggcnccctgctccaggagcacctcgagagcacagcggccctgggctgcctggtcaaggctacttccacatacgtcactgagcgggctggcaaggcgcatagnnnnnnn

SEQ ID NO: 149065 - DNA, 525 bp, Homo sapiens
  misc_feature: GYAE6OF01DBUUG.42.41.D08.1.454.CMB.1.raw
  modified_base (429)..(429): a, c, t, g, unknown or other
  misc_feature (429)..(429): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttccagacaggggcccccaagtcctcattttgagggcagtgaggggcctcaggcctttgtgcgctccgagtctggcgacagggcctccctgacaatctccggactccaggctgacgactacggtgattcgtattacgtcgctcatgctgccaagtctggcaattttggccttccctgacaatctcngactccaggctgaacgcgacgacgattatagtattcgcttaagtnattcgtanattcatcgcccttcacgttcactcccaaggcctgccccctcgg

SEQ ID NO: 149066 - DNA, 424 bp, Homo sapiens
  misc_feature: GYAE6OF01E2H06.42.41.D08.1.454.CMB.1.raw
  modified_base (418)..(424): a, c, t, g, unknown or other
  misc_feature (418)..(424): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnnnnn

SEQ ID NO: 149067 - DNA, 434 bp, Homo sapiens
  misc_feature: GYAE6OF01DFIUA.42.41.D08.1.454.CMB.1.raw
  modified_base (221)..(221): a, c, t, g, unknown or other
  misc_feature (221)..(221): n is a, c, g, or t
  modified_base (338)..(338): a, c, t, g, unknown or other
  misc_feature (338)..(338): n is a, c, g, or t
  modified_base (428)..(434): a, c, t, g, unknown or other
  misc_feature (428)..(434): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtcaccgtctcctcagcctccaccaacgggcccatccggtccttccccctggccgcccctgctccagganccacctcctagagcacacgccggccctgggctgcctggtcaaggactacttccacatacgtcactgagcgggctggccaaggcgcatagnnnnnnn

SEQ ID NO: 149068 - DNA, 558 bp, Homo sapiens
  misc_feature: GYAE6OF01CFW11.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctggatctactggacagtcgatcatcatttcctacattggtacctgcagtgtattttggggcttataacgttatttccttccagacacggggcccccaagtcctcattttgaggcagtgaggggccctcaggcctttgtgcgctccgagtctggcgacagggccctcctgacaactctccggatccgaggcctggacgacgtacggtgattcgtattacgtcgctcatcgctgcctaagtctggctaatttcggcctcctgaccaatctctgactcaggctgaacgacgacgacgtattattacgtagttcgtactttaagttgagtttcgtacgtattacattcggaacccttcgtaaccgtcaacggccccaaggcctccgtcccccg

SEQ ID NO: 149069 - DNA, 421 bp, Homo sapiens
  misc_feature: GYAE6OF01EG2DJ.42.41.D08.1.454.CMB.1.raw
  modified_base (221)..(221): a, c, t, g, unknown or other
  misc_feature (221)..(221): n is a, c, g, or t
  modified_base (418)..(421): a, c, t, g, unknown or other
  misc_feature (418)..(421): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactactggggtcagggaaccctggtcaccgtctcctcagcctccaccaagggcccatcggtcttccccctggcgccctgctccaggagcacctccgagacgcacagcggccctgggctgcctggtcaaggactacttccacatacgtcactgagcgggctggcaaggcgcatagnnnn

SEQ ID NO: 149070 - DNA, 467 bp, Homo sapiens
  misc_feature: GYAE6OF01CC27I.42.41.D08.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (439)..(467): a, c, t, g, unknown or other
  misc_feature (439)..(467): n is a, c, g, or t
tcagtgacgtatgtcacgaccggtgctcgatttagtcacgcgagaaagggaaaggggctggtgtgggtctcagctgttattggtgatgggataacacaagatacggggactccgtgaagggccgattcagcatctcagagacaacgccaaagaacacgttgtaatctaggaaatgaaacaatcgtgggagccgaggacacggctgtctatttcngtagtaaaaagntctggggcggtacaggttcgtttgactactggggtcaaggggaaccctggtcaccgtctcctnacgcctacaccgaagggcccatcggtccttccccctggccnccctgctccaggancacctccgagagnacagcggccctgggctgcctggcaaaggtctaacctccaanacgtaactcatggagcgggtcncggacaaggccganatagnnnnnnnnnnnnnnnnnnnnnnnnnnnnn

SEQ ID NO: 149071 - DNA, 433 bp, Homo sapiens
  misc_feature: GYAE6OF01B7UE1.42.41.D08.1.454.CMB.1.raw
  modified_base (222)..(222): a, c, t, g, unknown or other
  misc_feature (222)..(222): n is a, c, g, or t
  modified_base (425)..(433): a, c, t, g, unknown or other
  misc_feature (425)..(433): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntctgggcggtacaggtttcgtttgactacgtggggtcagggaccctggtcaccgtctcctcagcctccaccaagggccatccggtcttccccctggccgccctgcctccaggacgccaccctccgagacgcacagcggccctgggctcgctggtcaaggctacttccacatacgtcactgagcgggctggcaaggcgcatagnnnnnnnnn

SEQ ID NO: 149072 - DNA, 530 bp, Homo sapiens
  misc_feature: GYAE6OF01EMOTN.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagacaggggcccccaacgtcctcatttttgagggcagtgaggggccctcaggcctttgtgcgctccgagtctggcgacagggcctccctgacaatctccggactccaggctgacgactacggtgattcgtattacgtcgctcatgctgccaagtctggcaatttggcctcctgacatctctgactccaggctgaagcgacgacgattattagtagttcgcttaagttgatttcgtactattcatcgaccgtcctacgtcagcccaaggcctcgcccctcgg

SEQ ID NO: 149073 - DNA, 442 bp, Homo sapiens
  misc_feature: GYAE6OF01DAUK1.42.41.D08.1.454.CMB.1.raw
  modified_base (424)..(424): a, c, t, g, unknown or other
  misc_feature (424)..(424): n is a, c, g, or t
  modified_base (426)..(442): a, c, t, g, unknown or other
  misc_feature (426)..(442): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctggggagccgaggacacggctgtctatttctgtgtaaaagatctggggcggtacaggttcgtttgactactggggtcagggaaccctggtcaccgtctcctcagcctccaccaaggcccatcggtcttccccctggcgccctgctcccaggacgcaccctccgagagcacacgcggccctgggctgcctggtcaaggactacttccacatacgtcactgagcgggctggcaaggcgcaatagnannnnnnnnnnnnnnnnn

SEQ ID NO: 149074 - DNA, 529 bp, Homo sapiens
  misc_feature: GYAE6OF01AFMO7.42.41.D08.1.454.CMB.1.raw
  modified_base (222)..(222): a, c, t, g, unknown or other
  misc_feature (222)..(222): n is a, c, g, or t
  modified_base (508)..(529): a, c, t, g, unknown or other
  misc_feature (508)..(529): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntctggggcggtacaggtttcgtttgactacgtggggtcagggaccctggtcaccgtctcctcagcctccaccaacgggcccagtcggtccttccccccgtggccgcccctgcctccgaggacgccaccctccggagacgccaacgaggccgggccccgtgggcctcggtccccgttgggtaccaaacgggtaacccttaccttacccgaactaacgttacccgttaccaaccgttggacgggccgggggtcctacggggccgaaaggggccggacctagttacggnnnnnnnnnnnnnnnnnnnnnn

SEQ ID NO: 149075 - DNA, 581 bp, Homo sapiens
  misc_feature: GYAE6OF01CNY83.42.41.D08.1.454.CMB.1.raw
  modified_base (300)..(300): a, c, t, g, unknown or other
  misc_feature (300)..(300): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttcctccagacagggcccccaagtcctcattttgaggcagtgagggcctcaggcctttggngcgctccgagtctggcgacagggcctccgtgaccaatcctaccggactccgaggctagacgactacggtgattcgtattacgtcgctcatgctgccaagtctggactaagtttcggcctccgtagactaactcctctcggactccgaggctagaacgtacgacgacgtattagttagtacgttacgtacttaagttgtagttcgtactattccgtataccggtacccgttcccgtacgttccacggtaccccaaaggtccctcggtcccccccgttaccgg

SEQ ID NO: 149076 - DNA, 422 bp, Homo sapiens
  misc_feature: GYAE6OF01A072I.42.41.D08.1.454.CMB.1.raw
  modified_base (416)..(422): a, c, t, g, unknown or other
  misc_feature (416)..(422): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaggcgcatagnnnnnnn

SEQ ID NO: 149077 - DNA, 419 bp, Homo sapiens
  misc_feature: GYAE6OF01DA29E.42.41.D08.1.454.CMB.1.raw
  modified_base (407)..(407): a, c, t, g, unknown or other
  misc_feature (407)..(407): n is a, c, g, or t
  modified_base (413)..(419): a, c, t, g, unknown or other
  misc_feature (413)..(419): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccattcagcatctccagagacaacgccaagaacacgttgtatctggaaatgaaacaatctgggagccgaggacacggctgtctatttctgtgtaaaagatctgggcggtacaggttcgttgactactgggtcagggaccctggtcacgtctcctcagcctccaccaagggcccatcggtcctcccctggcgccctgctccaggacgccacctccgagagcacagcggccctgggctgcctggtcaaggctactccacatacgtcactgagcgggctggcaaggcncatagnnnnnnn

SEQ ID NO: 149078 - DNA, 585 bp, Homo sapiens
  misc_feature: GYAE6OF01B5DF8.42.41.D08.1.454.CMB.1.raw
  modified_base (184)..(184): a, c, t, g, unknown or other
  misc_feature (184)..(184): n is a, c, g, or t
  modified_base (220)..(220): a, c, t, g, unknown or other
  misc_feature (220)..(220): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (545)..(547): a, c, t, g, unknown or other
  misc_feature (545)..(547): n is a, c, g, or t
  modified_base (551)..(552): a, c, t, g, unknown or other
  misc_feature (551)..(552): n is a, c, g, or t
  modified_base (554)..(557): a, c, t, g, unknown or other
  misc_feature (554)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (574)..(577): a, c, t, g, unknown or other
  misc_feature (574)..(577): n is a, c, g, or t
  modified_base (579)..(581): a, c, t, g, unknown or other
  misc_feature (579)..(581): n is a, c, g, or t
  modified_base (583)..(585): a, c, t, g, unknown or other
  misc_feature (583)..(585): n is a, c, g, or t
tcagtgacgtatgtcacgaccggtgctcgatttagtcacgcgagaaagggaaagggcgtggtgtggtctcagctgttattggtgatgggagtatcacaagatacgggactccgtgaaggccgattcagcatctccagagacaacgccaagaacacgttgtatctggaaatgaacaatctggganccgaggacacggctgtctagtttctgtagtaaaagntctgggcggtacaggtttcgtttgactacgtggggtcacgggaacctggtcaccgttctcctcacgccttccgaccaagggcccatccggtccttcccccgtggccgccctacgccgtcccacgggacgcctaaccctccggagaagcctaacgacggccgggtccctgggggtcctcggcccgtttggggtccgaaaacgggtacccttaaccgttttaccaacgtacttaacccgggttccgtaaacttgggacgggccgggtaccgttacggggaccgaaaccggggccggtaccgtaaagtacgggncancancgngatgnnntgcnncnnnngncnncnntngngnngnnnncnnncnnn

SEQ ID NO: 149079 - DNA, 552 bp, Homo sapiens
  misc_feature: GYAE6OF01C0YRN.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgtataacgttatttccttccagacacggggcccccaacgtcctcattttgacgggtcagtgaggggcctcaggcctttgtgcgctccgagtctcggcgacagggccctcctgacaatctccggactccagctgacgactacggtgattcgtattacgtcgctcatgctgactaagtctggctaagtttcggcctccgtgtacaatctctcggactccaggctgaagacgacgacgtattatagttagttcgacgttaagtgtattcgtacattcagttcgaccgttacctacgtacacgacccgaaggcctcgcccccgtacg

SEQ ID NO: 149080 - DNA, 546 bp, Homo sapiens
  misc_feature: GYAE6OF01B5E2O.42.41.D08.1.454.CMB.1.raw
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcaggacacagggtcgtgggcccagtctgcaccgtgtctggtctactggacagtcgatcatcatttcctacattggtacctgcagtgattttggggcgtataacgttatttccttcccagacaggggcccccaacgtcctcattttgagggcagtgaggggccctcaggcctttgngcgctccgagtctggcgacagggccctcctgacaatctccggactccaggctgaccgactacggtnatttcgattacgcgctcatgctgcctaagtctggctaattcgcctcctgacatctctgactcaggctgaagacgacgacgtattattagtagttcgtcttaagtgtacttcgtactattcgtactgtacccgttcctacgtcgacgacccgaaggtcctccgcccccgtggtacc

SEQ ID NO: 149081 - DNA, 433 bp, Homo sapiens
  misc_feature: GYAE6OF01EP0G2.42.41.D08.1.454.CMB.1.raw
  modified_base (223)..(223): a, c, t, g, unknown or other
  misc_feature (223)..(223): n is a, c, g, or t
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
  modified_base (427)..(433): a, c, t, g, unknown or other
  misc_feature (427)..(433): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaagntcgtggggcgtacaggtttcgtttgactacgtggggtcagggaccctggtccaccgtctcctcagcctccaccaagggccatccggtcttccccctggcnccctgctccaggacgccacctccgagacgcacagccggccctgggctcgcctggtcaaggctactccacatacgtcactgagcgggctggcaagggcncatagnnnnnnn

SEQ ID NO: 149082 - DNA, 556 bp, Homo sapiens
  misc_feature: GYAE6OF01D3DE1.42.41.D08.1.454.CMB.1.raw
  modified_base (299)..(299): a, c, t, g, unknown or other
  misc_feature (299)..(299): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttccagacacggggccccccaagtcctctatttttgagggcagtgaggggccctnaggcctttgtgcgctccgagtctggcgacagggcctccctgacaatcctccggactccaggctgacgactacggtgattcgtattacgtcgctcatgctgccaagtctggctaagtttcggcctcctgacatctctgactcagctagaacgacgacgacgtattaattagttacgttcgtactttaagttgtagttccgtatacgttcattcgacccgtcctacgtcacgtaccccaaggtcctccgcccccgtcgg

SEQ ID NO: 149083 - DNA, 462 bp, Homo sapiens
  misc_feature: GYAE6OF01CW3HL.42.41.D08.1.454.CMB.1.raw
  modified_base (335)..(335): a, c, t, g, unknown or other
  misc_feature (335)..(335): n is a, c, g, or t
  modified_base (448)..(462): a, c, t, g, unknown or other
  misc_feature (448)..(462): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctggggcggtacaggttcgtttgactacgtggggtcagggaccctggtccaccgtctcctcagcctccaccaagggcccatccggtcttccccctggcgccctgctccaggcnccaccgtccgagagcacacgccggccctgggcctcgcctgggtacaacggtacctacttcccactactaccgtcacgtggacggcgggtctgggaccaagggccgacagtagnnnnnnnnnnnnnnn

SEQ ID NO: 149084 - DNA, 534 bp, Homo sapiens
  misc_feature: GYAE6OF01E1NZA.42.41.D08.1.454.CMB.1.raw
  modified_base (497)..(534): a, c, t, g, unknown or other
  misc_feature (497)..(534): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagatctgggcggtacaggttcgtttgactacgtggggtcagggaccctggtcaccgtctcctcacgccctccaccgaacgggcccatccggtcccttccccctgggcccgcccctgcctcccgaggacgccaccctccggaagacgccacgacggccggccctgggcctcggcccgtgggtaccgaaacggtaccttaccgttcccaactacttaccgtccaacgttcgggaacgggccggggcttagggaccgtaaacggggccgacgtaagtaggnnnnnnnnnnnnnnnnnnnnnnnnnnnnnnnnnnnnnn

SEQ ID NO: 149085 - DNA, 533 bp, Homo sapiens
  misc_feature: GYAE6OF01DB0ZM.42.41.D08.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (366)..(366): a, c, t, g, unknown or other
  misc_feature (366)..(366): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
  modified_base (497)..(533): a, c, t, g, unknown or other
  misc_feature (497)..(533): n is a, c, g, or t
tcagtgacgtatgtcacgaccggtgctcgatttagtcacgcgagaaagggaaagggctggtgtggggtctcagctgttattggtgatgggataaacacaacgagtacggggactccgtgaagggccattcagcatctccagaggaccaacgcctaagaacacgttgtaatctagggaaaatgaaacaatcctggggacnccggaggacacgggctggtcttatttcgtggtagtaaaaagntcgtaggggacgttaacngggtttcgtttgacgtacgtggggtcagggaaccctggtaccaccgttcctccgtcacgtcctccacgaacgggccctagtccggttccctttcccccgtggtcccncccgtgcctcccgaggacgccaccgtccggagacgcgacgacggccggccgtggcctcggtccgtggtacgaacgtactaccgtacacgatacgtcacgtgacgcggntcggacaaggccacagtantcannnnnnnnnnnnnnnnnnnnnnnnnnnnnnnnnnnnn

SEQ ID NO: 149086 - DNA, 603 bp, Homo sapiens
  misc_feature: GYAE6OF01BH2BR.42.41.D08.1.454.CMB.1.raw
  modified_base (384)..(384): a, c, t, g, unknown or other
  misc_feature (384)..(384): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagttttggggctataacgttatttcccttcccagacacggggcccccaacgtcctcattttgaggcagtgaggggccctcgaggcctttgtgcgctccgagtctggcgacgacgggccctccgtgaccaatcgtccggactccgaggctagacgacgtacggtnattcgtattacgtcgctcatgctgccaagtctaggactaagtttcggacccttccgtcgtaactaacttcctaccgtcggtacctccgacggtctagaacgacgtaacgacgtattaacgttagtagttcgtacttaaggttcgtattcgtaactagttctatacgtcccgttacctacgtacgaccgtacccaaggtccctcggtccccccgttacgg

SEQ ID NO: 149087 - DNA, 427 bp, Homo sapiens
  misc_feature: GYAE6OF01CDCKE.42.41.D08.1.454.CMB.1.raw
  modified_base (221)..(221): a, c, t, g, unknown or other
  misc_feature (221)..(221): n is a, c, g, or t
  modified_base (416)..(416): a, c, t, g, unknown or other
  misc_feature (416)..(416): n is a, c, g, or t
  modified_base (422)..(427): a, c, t, g, unknown or other
  misc_feature (422)..(427): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctggggcggtacaggttcgtttgactacgtggggtcagggaaccctggtcaccgtctcctcagcctcaccaagggcccatcggtccttccccctggccgccctgctccaggacgccacctccgagacgcacagccggccctgggcctgcctggtcaaggactactcacatacgtcactgagcggctggcaggcncatagnnnnnn

SEQ ID NO: 149088 - DNA, 420 bp, Homo sapiens
  misc_feature: GYAE6OF01BM2VN.42.41.D08.1.454.CMB.1.raw
  modified_base (221)..(221): a, c, t, g, unknown or other
  misc_feature (221)..(221): n is a, c, g, or t
  modified_base (417)..(420): a, c, t, g, unknown or other
  misc_feature (417)..(420): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttctttgactacgtggggtcagggaccctggtcaccgtctcctcagcctccaccaagggcccatcggtcttccccctgcgccctgctccaggacgcacctccgagagcacagccggccctgggctgcctggtcaaggctacttccacatacgtcactgagcgggctggcaaggcgcatagnnnn

SEQ ID NO: 149089 - DNA, 421 bp, Homo sapiens
  misc_feature: GYAE6OF01CHPC7.42.41.D08.1.454.CMB.1.raw
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (411)..(421): a, c, t, g, unknown or other
  misc_feature (411)..(421): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctggganccgaggacacggctgtctatttctgtagtaaaagntctgggcgtacaggttcgtttgactacgtggggtcagggaaccctggtcaccgtctcctcagcctccaccaaggccatcggtcttcccctgcgccctgctccaggagcacctcgagagcacagcgccctgggctgcctggtcaaggctactccacatacgtcactgagcgggctggcaaggcgcatagnnnnnnnnnnn

SEQ ID NO: 149090 - DNA, 428 bp, Homo sapiens
  misc_feature: GYAE6OF01CIKTU.42.41.D08.1.454.CMB.1.raw
  modified_base (422)..(428): a, c, t, g, unknown or other
  misc_feature (422)..(428): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaaagatctggggcgtacaggtttcgtttgactacgtggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaaggcgcatagnnnnnnn

SEQ ID NO: 149091 - DNA, 431 bp, Homo sapiens
  misc_feature: GYAE6OF01BBZX2.42.41.D08.1.454.CMB.1.raw
  modified_base (419)..(431): a, c, t, g, unknown or other
  misc_feature (419)..(431): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgacttacgtggggtcagggaaccctggtcaccgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnnnnnnnnnnn

SEQ ID NO: 149092 - DNA, 488 bp, Homo sapiens
  misc_feature: GYAE6OF01BVFWQ.42.41.D08.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (478)..(488): a, c, t, g, unknown or other
  misc_feature (478)..(488): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttcngtagtaaaaagntcgtggggcggtacaggtttcgtttgactacgtggggtcagggaaccctggtcaccgtctcctcacgcctccaccgaacgggcccagtccggtccttccccccgtggcccgcccctgcctccaggacgccaaccgtccgagacgcaccgaggtccggccctggggcctgccctgggtacaaaggccttaaccttcccgaactaagttaccgtcctaacgtggacggccggggctgggacaagggccgacagtagnnnnnnnnnnn

SEQ ID NO: 149093 - DNA, 443 bp, Homo sapiens
  misc_feature: GYAE6OF01A41G3.42.41.D08.1.454.CMB.1.raw
  modified_base (221)..(221): a, c, t, g, unknown or other
  misc_feature (221)..(221): n is a, c, g, or t
  modified_base (430)..(443): a, c, t, g, unknown or other
  misc_feature (430)..(443): n is a, c, g, or t
tcagtgacgtatgtcacgaccggtgctcgatttagtcacgcgagaaagggaaaggggctggtgtgggtctcagctgttattggtgatgggagtatcacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtcaccgtctcctcacgcctccaccaagggcccatccggtccttccccccgtggccgcccctgcctccgaggacgccacctccgagagcacgagcggccctgggctgcctggcaaggctactccacatacgtcactgacgcgggctggcgaagcgcatacgnnnnnnnnnnnnnn

SEQ ID NO: 149094 - DNA, 548 bp, Homo sapiens
  misc_feature: GYAE6OF01CVOM8.42.41.D08.1.454.CMB.1.raw
  modified_base (400)..(400): a, c, t, g, unknown or other
  misc_feature (400)..(400): n is a, c, g, or t
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagtttttggggcttattaacgtttatttcccttcccagaccacggggccccccaacgtcctcattttttgagggcagtgaggggccctcaggcctttgtgcgctccgagtctggcgacagggcctccctgacaatctccggacctcaggctgacgactacggtgatttcgtatttacgcnctcatgctgaccaagtctggctaattcggcctccctgacatcctctcgactccaggctagaacgacgacgacgtattattagtgttcnctttaagttntattcgtatnttcatgacctctacgtcagcccaaggcctcgccccctcgg

SEQ ID NO: 149095 - DNA, 535 bp, Homo sapiens
  misc_feature: GYAE6OF01A2BO3.42.41.D08.1.454.CMB.1.raw
  modified_base (222)..(222): a, c, t, g, unknown or other
  misc_feature (222)..(222): n is a, c, g, or t
  modified_base (510)..(535): a, c, t, g, unknown or other
  misc_feature (510)..(535): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcgtacaggttcgttgactacgtggggtcagggtaaccctggtccaccgtctaccctcacgccctccgaccgtaacgggccccagttcccggtcctttccccccgtgggcccgaccccgtgccctacccgagggacgcccacccgtccggaagacgccaacgtaggtccggccccgtgggcctacggcccgtagggtcgaaacggtacctttaccgttccaactacgtaccgtcaacgtcggaacggccgggtctgggaccgaagggtccgacgaataggcnnnnnnnnnnnnnnnnnnnnnnnnnn

SEQ ID NO: 149096 - DNA, 514 bp, Homo sapiens
  misc_feature: GYAE6OF01BRN21.42.41.D08.1.454.CMB.1.raw
  modified_base (223)..(223): a, c, t, g, unknown or other
  misc_feature (223)..(223): n is a, c, g, or t
  modified_base (345)..(345): a, c, t, g, unknown or other
  misc_feature (345)..(345): n is a, c, g, or t
  modified_base (483)..(514): a, c, t, g, unknown or other
  misc_feature (483)..(514): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaaagntcgtggggcgttacaggtttcgtttgactacgtggggtcagggaccctggtccaccgtctcctcacgcctccaccaacgggcccatcggtccttcccccgtggccgccctgcctccgaggcnccacctccgagacgccaacgacgccggcccgtggggcctcggccctgggtaccaaacgggtacctaccgttcccaacacttaccgtccaacgttgggaggtccgggacgtgggacgaaacgggccgacagtaggcagnnnnnnnnnnnnnnnnnnnnnnnnnnnnnnnn

SEQ ID NO: 149097 - DNA, 552 bp, Homo sapiens
  misc_feature: GYAE6OF01A6PCS.42.41.D08.1.454.CMB.1.raw
  modified_base (381)..(381): a, c, t, g, unknown or other
  misc_feature (381)..(381): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtattttggggcttataacgttatttccttccagacacggggcccccaacgtcctctatttttgagggcaggtgaggggcctcaggtcctttgtcgcgctccgagtcgtggcgacgagggccctcctgacaatctccggactccgaggctgacgactacggtnattcgtattacgtcgctcatgctgcctaagtctgctattcggcctcctagactatctcgtcgactccaggtctagaacgcgaacgtacgtattattagtattcgtacttaagtgtattccgtaatagttcatcgtacccgtctacgtcacgaccgaagcctcgccccgtcg

SEQ ID NO: 149098 - DNA, 529 bp, Homo sapiens
  misc_feature: GYAE6OF01DHOIM.42.41.D08.1.454.CMB.1.raw
  modified_base (224)..(224): a, c, t, g, unknown or other
  misc_feature (224)..(224): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (492)..(529): a, c, t, g, unknown or other
  misc_feature (492)..(529): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctctagagacaacgccaagaacacgttgtatctggaaatgaacaatctggggagccgaggacacggctgtctatttctgtagtaaaaagntcgtggggcggtactaggtttcgtttgactacgtggggtcagggaaccctggtccaccgtctccctcacgtcctcccaaccgaagggcccagtccggtccttccccccgtggcccncccctgcctccgagggcgccacctccgagacgccacgngccggcccgtggcctgcccgttgggtaccaaaggtaccttaaccgttcccaactacgttacgtccacgttggacgggccgggtctagggaccaagggcccgataacgtagcagnnnnnnnnnnnnnnnnnnnnnnnnnnnnnnnnnnnnnn

SEQ ID NO: 149099 - DNA, 529 bp, Homo sapiens
  misc_feature: GYAE6OF01APYME.42.41.D08.1.454.CMB.1.raw
  modified_base (485)..(485): a, c, t, g, unknown or other
  misc_feature (485)..(485): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgagttttggggctataacgttatttcctccagcacgggcccccaagtcctcatttttgaggcagtgaggggcctcaggcctttgtgcgctccgagtctggcgacagggcctcctgacaatctccggactccaggctgacgactacggtgattcgtattacgtcgctcatgctgccagtctggctatttcgcctcctgacatctctcgctccaggctagaacgacgacgacgatttattagtacgttcgactttagtgacttcgtacngtttcattcgtcctcctagtcacgcccaaggcctcgcccctcgg

SEQ ID NO: 149100 - DNA, 515 bp, Homo sapiens
  misc_feature: GYAE6OF01CAXV8.42.41.D08.1.454.CMB.1.raw
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
  modified_base (451)..(451): a, c, t, g, unknown or other
  misc_feature (451)..(451): n is a, c, g, or t
  modified_base (456)..(457): a, c, t, g, unknown or other
  misc_feature (456)..(457): n is a, c, g, or t
  modified_base (459)..(460): a, c, t, g, unknown or other
  misc_feature (459)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (472)..(477): a, c, t, g, unknown or other
  misc_feature (472)..(477): n is a, c, g, or t
  modified_base (479)..(479): a, c, t, g, unknown or other
  misc_feature (479)..(479): n is a, c, g, or t
  modified_base (482)..(484): a, c, t, g, unknown or other
  misc_feature (482)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(492): a, c, t, g, unknown or other
  misc_feature (490)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (499)..(502): a, c, t, g, unknown or other
  misc_feature (499)..(502): n is a, c, g, or t
  modified_base (505)..(507): a, c, t, g, unknown or other
  misc_feature (505)..(507): n is a, c, g, or t
  modified_base (509)..(511): a, c, t, g, unknown or other
  misc_feature (509)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
tcagtgacgtatgtcacgaccggtgctcgatttagtcacgcgagaaagggaaaggggcctaggtgtcgggtctcgagctcgttattggtgatgggagtaacacaaagatacggggactccgtgaagggccgattcagtcatcgtccagagaacaacgccaagaaccacgttcgtatctggaaatgaacaatctgggagccgaggacacggctgtctatttcgtgtagtaaaaagntcgtgggcgtacaggtttcgtttgactacgtgggtcagggaaccctggtcacgtctcctgagcctcacacggccagtcggtcttccccgnggcgccctgctccgagacgcaccgtcgagacgcacgacgccgcctggctcgccgtcggacaacggactacttccacgtactaccgtacacgtcgacgcgggctacggactaacggcgacagtacgntacgnngnngngngngngngnnnnnngngtnnngngngnnngngngtnnnnctnnncnnngngn

SEQ ID NO: 149101 - DNA, 660 bp, Homo sapiens
  misc_feature: GYAE6OF01CJR4W.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacgagggtcgtggcccagtctgcatccgtgtctgggtctactggacagtcgatcatctactttcctactattcggtacctgctagttgtagttttggggacttaattaacgtttactttcccgtaccaaggaccgaccggggcccccaacgtcctctagtttttggagggtcagtggacggggtccctcgacggtcctttgcgccgcgtccgagtcgtcggacgacgacgggccctccgtgaactacgtccgtaccggacctcgacggctacgaacgtacgtacggtgtacgttacgtacgttacgtcgtctcgatcgctcgacctagtcgtagtactagttccggaccttccgtagacctaactcctacgtcgtaccctcgtacggctaacgaacgtacgaacgtacgttaactttaagttagttaacgttcgtagtttaagttcgtattaccgtactagttacagttaccgtaccttacccgtagtcgaccgacgtacggtccctccgtccccgttaccgg

SEQ ID NO: 149102 - DNA, 572 bp, Homo sapiens
  misc_feature: GYAE6OF01DK0BW.42.41.D08.1.454.CMB.1.raw
  modified_base (343)..(343): a, c, t, g, unknown or other
  misc_feature (343)..(343): n is a, c, g, or t
  modified_base (396)..(396): a, c, t, g, unknown or other
  misc_feature (396)..(396): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagacgacggggcccccaacgtcctccatttttgagggcagtgaggggccctcgaggcctttgtgcgctccgagtctggcgacaggggcctcccngacaatctccggactccaggctgacgactacggtgattcgtattacgtcgctnatgctgccaagtctggctaagtttgcccttcctgaccaattctctgacctccgaggctagaacgaccgacgacgtattaattagttagttcgacgttaagttcgtatttcgtaacttattccattacggtaccgttccctacgtaccgacgcccaaggcctccgcccccgttccgg

SEQ ID NO: 149103 - DNA, 543 bp, Homo sapiens
  misc_feature: GYAE6OF01BT6V4.42.41.D08.1.454.CMB.1.raw
  modified_base (317)..(317): a, c, t, g, unknown or other
  misc_feature (317)..(317): n is a, c, g, or t
  modified_base (400)..(400): a, c, t, g, unknown or other
  misc_feature (400)..(400): n is a, c, g, or t
  modified_base (487)..(487): a, c, t, g, unknown or other
  misc_feature (487)..(487): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgagttttggggcgttataacgttatttcccttcccagaccacggggcccccaacgtcctctatttttgagggcagtgaggggccctcacggtcctttgngcgctccggagtctggcgacgagggcctccgtgacaatccgtccgactccgaggctgacgactacggtgattcgtattcgtcnctcatgctgcctagtctgctattgcctcctgacatctctgacctcagctagagacgagacgtagttattagtcgttatacttaagtnattcgtatacttcatcgaccgtcctacgtacacgacccagtcctccgccccgtacg

SEQ ID NO: 149104 - DNA, 634 bp, Homo sapiens
  misc_feature: GYAE6OF01CKI6U.42.41.D08.1.454.CMB.1.raw
  modified_base (384)..(384): a, c, t, g, unknown or other
  misc_feature (384)..(384): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagttttggggcgttataacgtttatttccttcccagaccgacggggcccccaacgtcctcatttttgagggcagtgacggggccctcgaggtcctttgtgcgcgtccgagtctggcgacagggcctccctgacaatctccggactccagctgacgactacggtnattcgtattacgcgctcatgctgccagtctggctaatttcggcctccctgactaatcctctcgacctccgaggctagaacgtaccgaacgtacgtaactttagttaagttacgttacgttacgtttaaagtttgtactttacggtaactagtttcctagttccggttaacccgttacccgttaaccgttacccgtaacggtacccccgaaaagggttccccttcccgggtccccccccgtttacccgggg

SEQ ID NO: 149105 - DNA, 428 bp, Homo sapiens
  misc_feature: GYAE6OF01C5BIQ.42.41.D08.1.454.CMB.1.raw
  modified_base (421)..(428): a, c, t, g, unknown or other
  misc_feature (421)..(428): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaaggcccatcggtcttccccctggccgccctgctccaggacgcacctccgagagcacagcggccctgggctgcctgtcaaggactacttccacactacgtcactgagcgggctcggcaaggcgcagtagnnnnnnnn

SEQ ID NO: 149106 - DNA, 526 bp, Homo sapiens
  misc_feature: GYAE6OF01DFVQT.42.41.D08.1.454.CMB.1.raw
  modified_base (211)..(211): a, c, t, g, unknown or other
  misc_feature (211)..(211): n is a, c, g, or t
  modified_base (494)..(494): a, c, t, g, unknown or other
  misc_feature (494)..(494): n is a, c, g, or t
  modified_base (502)..(526): a, c, t, g, unknown or other
  misc_feature (502)..(526): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttcngtagtaaaaagtcgtggggcgtacaggtttcgtttgactacgtggggtacaacgggaccctggtccaccgtctcctcacgccctccaccgaacgggccctagtccggtccttccccccgtggcccgtcccctgcctccgaggacgccacccgtccgagacgcaaccgaggtcccggcccgtggggcctcggccgttacgggtaccaaacgggtacctttaaccttcccactaacgttaccggtcaaccgtgacggggccgggtcgtaggaccgaagggccganaacgtagnnnnnnnnnnnnnnnnnnnnnnnnn

SEQ ID NO: 149107 - DNA, 630 bp, Homo sapiens
  misc_feature: GYAE6OF01CAQH5.42.41.D08.1.454.CMB.1.raw
  modified_base (273)..(273): a, c, t, g, unknown or other
  misc_feature (273)..(273): n is a, c, g, or t
  modified_base (422)..(422): a, c, t, g, unknown or other
  misc_feature (422)..(422): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgagttttggggctataacgttatttccttcccagacaggggccccaagtcctctnttttgaggcagtgacgggcctcgaggtcctttggtcgcgtactccgagtctggccgacgacggggtccctcccgtagaacctaacgtccgttaccggacctcccgaaggccgtagaccggtactacggtgtattcggtaagttacgtcnctcatgctgaccagtctggtactaagtttcggacccttccgtagaacctaactctacgtacggaccttcgaggtctagaacgacgaacgacgtaatttactacgttagtcgtactttaagttcgtacgtttcgtaactagttacctagtaccgtaccgttacctaacgttaccacgaccccgaaggtccctccggtccccccgtacgg

SEQ ID NO: 149108 - DNA, 456 bp, Homo sapiens
  misc_feature: GYAE6OF01C0FB2.42.41.D08.1.454.CMB.1.raw
  modified_base (222)..(222): a, c, t, g, unknown or other
  misc_feature (222)..(222): n is a, c, g, or t
  modified_base (450)..(456): a, c, t, g, unknown or other
  misc_feature (450)..(456): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccattcagcatctccagagacaacgccaagaacacgttgtatctaggaaatgaacatcgtgggagccgaggacacggctgtctatttctgtagtaaaagntcgtgggcggtactaggtttcgtttgactacgtggggtacagggaccctggtccacgtctcctcacgcctccaccaacgggcccatccggtccttcccccgtggccgccctgcctccgaggacgccacctcgagacgcacgagtccggcccgtgggcctgccgtggtaccaaggtacctacttccactactacgtcacgtgacggcgggctaggacgaggcgcatagnnnnnnn

SEQ ID NO: 149109 - DNA, 429 bp, Homo sapiens
  misc_feature: GYAE6OF01CPC6U.42.41.D08.1.454.CMB.1.raw
  modified_base (225)..(225): a, c, t, g, unknown or other
  misc_feature (225)..(225): n is a, c, g, or t
  modified_base (417)..(417): a, c, t, g, unknown or other
  misc_feature (417)..(417): n is a, c, g, or t
  modified_base (423)..(429): a, c, t, g, unknown or other
  misc_feature (423)..(429): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaaagaacacgttgtatctaggaaatgaacaatctggggagccgaggacacggctgtctatttctgtagtaaaagntctggggcggtacaggtttcgtttgactacgtggggtcagggaccctggtccaccgtctcctcagcctccaccaagggcccatcggtcttccccctggcgccctgctccaggagcacctcgagagcacagccggccctgggctgcctggtcaaggctacttccactacgtcactgagcgggctggcaaggcncatagnnnnnnn

SEQ ID NO: 149110 - DNA, 531 bp, Homo sapiens
  misc_feature: GYAE6OF01DS529.42.41.D08.1.454.CMB.1.raw
  modified_base (226)..(226): a, c, t, g, unknown or other
  misc_feature (226)..(226): n is a, c, g, or t
  modified_base (499)..(499): a, c, t, g, unknown or other
  misc_feature (499)..(499): n is a, c, g, or t
  modified_base (508)..(531): a, c, t, g, unknown or other
  misc_feature (508)..(531): n is a, c, g, or t
tcagtgacgtatgtcacgaccggtgctcgatttagtcacgcgagaaagggaaaggggctggtgtgggtctcagctgttattggtgatgggagtaacacaagatacggggactccgtggaagggccgattcagcatcctcagagacaacgccaagaacacgttgtatctaggaaatgaacaatcgtgggagccgaggacacggctgtcttatttcagtagtaaaagntcgtggggcggtacgtaggtttcgtttagacttacggtggggtacacgggaaccctggtaccaccgtctccgtcacgccctacccaaccgaacgggccctacgtcccggtccttccccccgtggcccgtcccctcgccgtccgaagggacgccaccgtccggagacgccacgacgccggtcccgtgggcctcgccgtgtacgaacggtcttaccgttaccactaacgttaccgtccgacgtggacggcgggtacggtcggacgacgggccganaacgtagcnnnnnnnnnnnnnnnnnnnnnnnn

SEQ ID NO: 149111 - DNA, 752 bp, Homo sapiens
  misc_feature: GYAE6OF01CMDWL.42.41.D08.1.454.CMB.1.raw
tcagtgacgtatgtcacgaccggtgctcgatttagtcacgcgagaaagggaaagggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgagttttggggctattaacgttatttccttccagaccgacggggcccccaacgtcctctattttgagggcaggtgacggggccctcgaggtcctttggtcgccgtccgtcccggagttccgtgggaccgacgtaccggggtcccttccccgtagaacctaacgtccgtcccggacctcccgacggtccgtacggaaccgtacgttacgggtcgtacgtttcgtaacgtttaccggtccgtccttactagttcgtccgtacggtacccgtaacgttcgtacgggtaccttaacggttttcccgggaccccttacccgtagaccttaacttccgttcgtaccggtaccctaccgtaggtactaacgggaaacggtaccgtaacggtaaccgttaatttaacgttaacggttacgtttacccgttaagttttaacggttacgtacgtttaccgttactaacgtttcacgttaccggtacccgttacccgttacgttccgaaccggttccccgaaggtcccctcccggtcccccgttcg

SEQ ID NO: 149112 - DNA, 489 bp, Homo sapiens
  misc_feature: GYAE6OF01DSB50.42.41.D08.1.454.CMB.1.raw
  modified_base (469)..(470): a, c, t, g, unknown or other
  misc_feature (469)..(470): n is a, c, g, or t
  modified_base (472)..(489): a, c, t, g, unknown or other
  misc_feature (472)..(489): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctcagagacaacgccaagaacacgttgtatctaggaaatgaacaatcgtgggagccgaggacacggctgtctatttctgtagtaaaagatcgtggggcggtactaggttcgtttgactacgtggggtcagggaaccctggtccaccgtctcctcacgcctccaccgaaggcccatccggtcttcccccgtggccgcccctcgctccaggagccacccgtccgagacgcaacgagccgggccccgtgggcctgcccgtgggtaccaacgggtaccttaccgttcccactaataccgtccacgttggaggtcgggctggacgaaggcgccaagtagnngnnnnnnnnnnnnnnnnnn

SEQ ID NO: 149113 - DNA, 558 bp, Homo sapiens
  misc_feature: GYAE6OF01DUX3R.42.41.D08.1.454.CMB.1.raw
  modified_base (343)..(343): a, c, t, g, unknown or other
  misc_feature (343)..(343): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttccagacacggggcccccaagtcctcatttttgagggcagtgaggggcctcaggcctttgtgcgctccgagtctggcgacagggcctcctgacaatcnccggactccaggctgacgactacggtgattcgtattacgtcgctcatgctgccaagtctggactaatttcggccttccctgactaactcttctggtacctccgacggctaggaacgacgaacgacgtattattagttagttcgatttaagttgattcgtactgttccattcgacccgttcctacgtacacgcccaaggcctcgcccccgttccgg

SEQ ID NO: 149114 - DNA, 431 bp, Homo sapiens
  misc_feature: GYAE6OF01DPRKG.42.41.D08.1.454.CMB.1.raw
  modified_base (224)..(224): a, c, t, g, unknown or other
  misc_feature (224)..(224): n is a, c, g, or t
  modified_base (422)..(431): a, c, t, g, unknown or other
  misc_feature (422)..(431): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaaacaatctgggagccgaggacacggctgtctaatttctgtagtaaaaagntcgtggggcgtacagggttcgtttgactactggggtcagggaaccctggtcaccgtctcctcagcctccaccaagggccatcggtcttcccctggcgccctgctccaggagcacctcgagagcacagcggccctgggctgcctggtcaaggactacttccactatacgtcaactgagcgggctggcaaggcgcatagnnnnnnnnnn

SEQ ID NO: 149115 - DNA, 534 bp, Homo sapiens
  misc_feature: GYAE6OF01DDCC0.42.41.D08.1.454.CMB.1.raw
  modified_base (222)..(222): a, c, t, g, unknown or other
  misc_feature (222)..(222): n is a, c, g, or t
  modified_base (330)..(330): a, c, t, g, unknown or other
  misc_feature (330)..(330): n is a, c, g, or t
  modified_base (496)..(496): a, c, t, g, unknown or other
  misc_feature (496)..(496): n is a, c, g, or t
  modified_base (499)..(534): a, c, t, g, unknown or other
  misc_feature (499)..(534): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtgtaaaaantcgtgggcgtacaggttcgtttgactacgtggggtcagggaaccctggtcaccgtctcctcacgcctccaaccgaacgggcccagtccggtcccttcccccgtggccncccctgcctcccgaggacgccaccgtccgaagacgcacacggtcggcccgtggctcgaccgtggtaccaaacggtacctaccttcccgaactacgttaaccgtccgtaactgggaacgggcccgggcgtacgggacccgaaacggggcccgtacgaacgttaaggnagnnnnnnnnnnnnnnnnnnnnnnnnnnnnnnnnnnnn

SEQ ID NO: 149116 - DNA, 799 bp, Homo sapiens
  misc_feature: GYAE6OF01DXDO6.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacgagggtcgtgggcccagtctgcatccgtgtcgtggtctactggacagtcgatcatctatttcctactagttcggtacctgacagttgtagttttggggacgtttaattaaccgtttactttccccttacccaggaccgacccggggacccccctaacgttcccttcttagtttttggacgggtctaggtcggacggggtccctcgacgggtccttttggtcggtccgtccgtcccggtacggttcgtcggaccgacggtaccgggtccccttcccgtacgaaccaacgttccccgtccggtaacctccgacggctacggtaaccgtaacgtaccgggttacgtacgtttaccgttaacgttccgtaccggtcctttacgtcgtaccggtcgttaccggtacccgtaaacgggttcttaaccgggactttaacgtttaccccggccctttacccgagtaaacctaccgttccgttaccgtccggtaaccctccggaggtaccgtaacggtaacgaccgtaaccgtacgttaagttaacgtttacgtacgtttcgtaactttaggtacttaacgttcgtaacttgttaaccgattacccggtcccgttaccgtaccgaccgtaacgtaccccgtaaacgtcccgtccccgtccccgttaccg

SEQ ID NO: 149117 - DNA, 594 bp, Homo sapiens
  misc_feature: GYAE6OF01C3UI3.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttattccttccagacaggggcccccaacgtcctcatttttgagggcagtgaggggccctcaggtcctttggtgcgctccgagtctggcgacgacgggcctccctgacaatctccggactccagctgacgactacggtgacttcgtattacgcgtctcatgctgaccaagtctggctaatttcggcctcctgactatctctcggacctcgaggctaggaacgaccgacgaacgtatttaagttacgttacgtttacgtactttaaggttgtacgttacgttactacgttctattaccggacccgttaccgtaccgtaccgacgtaccccaagggtccctccggtcccccccgttacggg

SEQ ID NO: 149118 - DNA, 492 bp, Homo sapiens
  misc_feature: GYAE6OF01DHR62.42.41.D08.1.454.CMB.1.raw
  modified_base (332)..(332): a, c, t, g, unknown or other
  misc_feature (332)..(332): n is a, c, g, or t
  modified_base (480)..(492): a, c, t, g, unknown or other
  misc_feature (480)..(492): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaaagaacacgttgtatctaggaaatgaacaatctggggagccgaggacacggctgtcttatttctgtagtaaaagatcgtggggcggtactaggttcgtttgactacgtggggtcagggaaccctggtccaccgtctcctcacgccctccaccaacgggcccagtccggtccttccccccgngggcccgcccctgcctcccgagggacgccacccgtccgagacgccaacgacgccggcccgtgggctcggccgtgggtaccaacggtaccttacttcccactactacgtcacgtgaggccgggctacgggacgacggtccgacagtagnnnnnnnnnnnnn

SEQ ID NO: 149119 - DNA, 514 bp, Homo sapiens
  misc_feature: GYAE6OF01CINXG.42.41.D08.1.454.CMB.1.raw
  modified_base (489)..(490): a, c, t, g, unknown or other
  misc_feature (489)..(490): n is a, c, g, or t
  modified_base (492)..(514): a, c, t, g, unknown or other
  misc_feature (492)..(514): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatcgtggggagccgaggacacggctgtctatttctgtagtaaaagatcgtggggcggtacaggtttcgtttgactacgtggggtcacgggaaccctggtccaccgtctcctcagcctccaccaacgggcccagtccggtccttccccctggcccgcccctgcctccgaggacgccacccgtccggagacgccacgaggcccggcccgtgggcctgcccgtgggtcgaaacggcttacccttaccactaacttaccgtcaacgtcggacggccggggtcgtcgggacgaacgggtccgacgtaacgtagcnncnnnnnnnnnnnnnnnnnnnnnnn

SEQ ID NO: 149120 - DNA, 645 bp, Homo sapiens
  misc_feature: GYAE6OF01C6RXA.42.41.D08.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (381)..(381): a, c, t, g, unknown or other
  misc_feature (381)..(381): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (621)..(645): a, c, t, g, unknown or other
  misc_feature (621)..(645): n is a, c, g, or t
tcagtgacgtatgtcacgaccggtgctcgatttagtcacgcgagaaagggaaaggggctggtgtgggtctcagctgttattggtgatgggagtaacacaagatacggggactccggtgaagggccattcagcatctcagagacaacgccaaagaacacgttgtatctaggaaatgaaacaatcgtggggagccgaggacacggctgtctatttctagttaagaaagtntcggngggtaccgtaagtggtttcgttagaccgttagggtcggggtaccgaaaccgggtaccgttggtacccgtaccttcctccgtaccaccgtcccctaccgaaaccggtaccgggtccctacggttccccgggtttcccccttaccccggngggccccccgtaccggttccgaccgttacccgggaacggaccgacccccgtaccggaaccggaacggggtaccacccgaaacggcccggggccccgggtccccggttacggggtcctaaccgggtcccgttacggggaaacccgtaacgttacccctttaccctacccgaaagttaccgttacccgaccgttaggacgggaccgggtccgggtcgacgggaacgacggctagngtagncnnnnnnnnnnnnnnnnnnnnnnnnn

SEQ ID NO: 149121 - DNA, 996 bp, Homo sapiens
  misc_feature: GYAE6OF01BYJP2.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttcctactattggtacctgcagttgtagttttggggcttattaacgtttactttcccttccaagaccgaccggggacccccaacgttcctctatttttcggagggcaggtggacgggcctacgaggtcctttggtcgcgctccgtaggtccgtcggcgacgacgggtcctacccgtgaacctaacgttccgtacccggtacctcccgaacggtccgttacggaaccgtaccggttaacggttacgtaacgttttacggttaacgtttaccggttcggtacccgttactaacggttcggtacccttacgggtaaccccgttaaacggtttcccggttaacgggtaaccgtttaacgggtttttaccccgggtacccccgtttacccggtaaccggtaaaccgttaaaccgtttcccgtttacccggttaccgggtttaaccccgtacccggaacgggtttaccgtaaacgggttaaacccgggaaccgggtaaacccgggttaaaccggttaaacgtttttaaacggtttaaaccggggttttaaccggtttttaaccgggtttaaaccgttttaacggggtttaacggttttaaaccgttttacccggtttaaaccctttaacggtttttccgaaacccggtttttaacccggggttaacccccgttttaaacccccggtttaccggggttaacccccccggtttaaaccccgggtttaaaccccccggtaaacccgggggttttcccccccggttaaccccccggggttccccccccccccgggttttaaacccgggg

SEQ ID NO: 149122 - DNA, 650 bp, Homo sapiens
  misc_feature: GYAE6OF01BA0AS.42.41.D08.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
  modified_base (609)..(611): a, c, t, g, unknown or other
  misc_feature (609)..(611): n is a, c, g, or t
  modified_base (615)..(620): a, c, t, g, unknown or other
  misc_feature (615)..(620): n is a, c, g, or t
  modified_base (622)..(625): a, c, t, g, unknown or other
  misc_feature (622)..(625): n is a, c, g, or t
  modified_base (627)..(633): a, c, t, g, unknown or other
  misc_feature (627)..(633): n is a, c, g, or t
  modified_base (635)..(635): a, c, t, g, unknown or other
  misc_feature (635)..(635): n is a, c, g, or t
  modified_base (637)..(642): a, c, t, g, unknown or other
  misc_feature (637)..(642): n is a, c, g, or t
  modified_base (644)..(645): a, c, t, g, unknown or other
  misc_feature (644)..(645): n is a, c, g, or t
  modified_base (647)..(650): a, c, t, g, unknown or other
  misc_feature (647)..(650): n is a, c, g, or t
tcagtgacgtatgtcacgaccggtgctcgatttagtcacgcgagaaagggaaaggggctgggtgtgggtctcagctgttattggtgatgggagtaacacaagatacggggactccgtgaaggccgattcagcatctccagagacaacgccaaagactacgttgtatctaggaaaatgaacaatcgtgggacgccggaggacacgggctgttcttattttcgngtaggtaaaaagntcggtaggggcggtactagggtttcgtttagaccttacgtggggtcaacggggtaccctggtccaccggttccttccgtcgacgtccctaccgaaccgaacgggccctagttccggtcccctttcccccgagggccctcccctggccccgtccgaagggtaccgtacccacccgtccgggaagtccgaccgaaccgtcgggtccccggtcccgttaggggccttcgggacccgtttcgggtaaccaaaccggggtacctttaacccgttaccaaaccgttacggttaacccggcttaaaccggtgggaaccggggtccgggtaccgttagggaaccaacgggggttccaacgtaaaggtgccngtacancgtannntcannnnnncnnnngnnnnnnngngnnnnnncnnannnn

SEQ ID NO: 149123 - DNA, 517 bp, Homo sapiens
  misc_feature: GYAE6OF01D7KEG.42.41.D08.1.454.CMB.1.raw
  modified_base (226)..(226): a, c, t, g, unknown or other
  misc_feature (226)..(226): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (493)..(517): a, c, t, g, unknown or other
  misc_feature (493)..(517): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaaacaatcgtgggagccgaggacacggctgtcttatttctgtagtaaaagntcgtgggcgtactaggtttcgttagactacgtggggtcacgggaccctggtccaccgtctcctcacgccctccaaccgaacgggccctacgttccggtcccttcccccgtcggcccgccccgtcggcctccgacggacgcccaccgtccggagacgccacgcggccggcccgtgggcctcgccgtaggtaccaaggtaccttacctaccactaacttccgacacgtggacggccgggtctcgggacgaacggcganagtangcangnnnnnnnnnnnnnnnnnnnnnnnnn

SEQ ID NO: 149124 - DNA, 465 bp, Homo sapiens
  misc_feature: GYAE6OF01AQ6TS.42.41.D08.1.454.CMB.1.raw
  modified_base (229)..(229): a, c, t, g, unknown or other
  misc_feature (229)..(229): n is a, c, g, or t
  modified_base (437)..(437): a, c, t, g, unknown or other
  misc_feature (437)..(437): n is a, c, g, or t
  modified_base (456)..(465): a, c, t, g, unknown or other
  misc_feature (456)..(465): n is a, c, g, or t
tcagtgacgtatgtcacgaccggtgctcgatttagtcacgcgagaaagggaaaggggctggtgtgggtctcagctgttattggtgatgggagtaacacaagatacggggactccggtgaagggccgattcagcatctccagagacaacgccaaagaacacgttgtatctaggaaatgaaacaatcgtagggagccgaggacacggctgtctatttctgtagtaaaaagntcgtggggcgtactaggtttcgtttgactacgtggggtcacgggtaccctggtccaccgtctcctcagccctccaaccgaagggcccatccggtccttcccccgtggccgcccctgcctccgaggacgccacctccgagacgcacagccggcccgtgggctcgcgtggtacaaggacctacttccacatacgcactggacggtcgggntggcaaggcgtacagtagnnnnnnnnnn

SEQ ID NO: 149125 - DNA, 434 bp, Homo sapiens
  misc_feature: GYAE6OF01A54OT.42.41.D08.1.454.CMB.1.raw
  modified_base (222)..(222): a, c, t, g, unknown or other
  misc_feature (222)..(222): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
  modified_base (426)..(434): a, c, t, g, unknown or other
  misc_feature (426)..(434): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcggtacaggttcgtttgactacgtggggtcagggaccctggtcaccgtctcctcagcctccaccgaagggcccatcggtccttcccccgtggccgcccctgcctccgaggagccacctccgagacgcacgagcggccctgggctcgcctggtcaggactactccanatacgnactgagcggctggcaggcncatagnnnnnnnnn

SEQ ID NO: 149126 - DNA, 740 bp, Homo sapiens
  misc_feature: GYAE6OF01DT88J.42.41.D08.1.454.CMB.1.raw
tcagtgacgtatgtcacgaccggtgctcgatttagtcacgcgagaaagggaaaggggggggtcaacaagacggcagcgctcctcgggacgtctccaccatcggcctgggctctgctactcctcactcttccttactcaggacacagggtcgtggcccagtctgcatccgtgtctgggtctactggacaggtcgatcatcatttcctacagttggtacctgcagtgtattttgggctataacgttattcccttccagacacggggcccctaacgtcctactatttttgaggctagtggagggcctgacggtccttgtcgcgctccggagtcgtgggcgacgacgggccttccgtgacaactccgtaccgactccgaggctacgaacgtacgtacggtgtagttacgtagttaccgcgtccgtactagtcgacctgacctaagtcgtacgtactaacgttcggcccttaccgtagacctaactccttacggtacggtaaccctccgtaacgggaccgtaacggaacggtaaccgtaaccggtaacgttaacgtttaaggtttaacggttaacggtttacgttaccgttttaaaggtttcggttaaaccgtttaccgttaacgttaaacgtttaccgttaaggttacccggttaaacccggtttacccttaaccgggttaaccttaacccggggacccgttaaacgggtccccgttcccgggtccccccggtttaacccgggg

SEQ ID NO: 149127 - DNA, 801 bp, Homo sapiens
  misc_feature: GYAE6OF01ER1O2.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctatattggtacctgcagtgtagttttggggacgttattaacgtttactttcccttcccagacgacggggtacccccctaacgtcctctatttttggaagggcaggtggacggggtccctacgacggtccctttggtcgcgtctccgagtcgtcgggcgacgacggggtcctcccgtgaactaactccgtaccggactaccaggctcggacgaacttacgggtagtacgtttacggtacttacggtcgtcttacgtagttcgtaccgtacgtaccctaaaggttccgtaggggtacctttaaaggttttcccgggtaccccttaccccgttacggtaaaccctaaacgtttcccgttacccgttcgggaaccctttacccgaacgggtcccgtaacgggtaaacggaacccggtaaccggtaacccggttaattttaaacgtttaacggttaacggttttaccggtaacgttttaaacggttagttaactttaccggttaaccttacgttacttaagttaccgttaacccgtttacccgtaaccgttaacccgtacccggtacccgaaacgggtcccttccccggtccccccgttacccggg

SEQ ID NO: 149128 - DNA, 770 bp, Homo sapiens
  misc_feature: GYAE6OF01ADNZR.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagtttggggctattaacgttattccctccagaccgacggggcccccaagtcctctattttggagggcaggtggacggggtccctcgtaggtcctttaggtcgcgtccgtccggagtcgtgggtccgacgacgggtcctcccgtgactaactccgtccggtacctccgaggctacggaccgtacgtacggtagtacgttcgtagttaccggtccgtctacgtatcgtctcgtaccgtaagtcgtcggtacttacgtttcggacccttaccgtagtaaccgtaacgttccgtaccgtacggtaccctaccggacgggttcctaacgggaaaccggtaccggaaccggtaaccgttaagtttaaccggttaacgtttcgggttaaccggttaacgttttaacggttaccggttaactttaccgggttaaactacgtttaccgtaaccggttaccggttaccccggtttacccccgtttaacccgaccgggtaaaccccgtcccccggttaaacgggtccccgtttaccccccggtcccccggtttaccccggg

SEQ ID NO: 149129 - DNA, 656 bp, Homo sapiens
  misc_feature: GYAE6OF01A5VSY.42.41.D08.1.454.CMB.1.raw
  modified_base (328)..(328): a, c, t, g, unknown or other
  misc_feature (328)..(328): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctactattggtacctgcagtgtagttttggggctataacgtttatttcccttcccagaccgacggggccccccaacgtccctctatttttggagggtcaggtggacggggtccctcgacggtcctttgngcgctcccgtagtctggtcgacgacgggtccctccgtacgactaatcccgtccggtaacctccgacggctacgacgtacgtacggtgtacgtttcgtacttacgtcgtctctagtcgcgtacgaccgtaagtcgtagacctaagtttcggccctacccgtgaccaacttcctacgtcggtacctcccgaaggtcctagaacgaaccgacgaacgtattagttagttacgttcgtacgttaagtgttaacttcgtactagtttaccattcggtaacccgttccgacgttccaccgtacccgaagggtcccttcccggtcccccttacgg

SEQ ID NO: 149130 - DNA, 583 bp, Homo sapiens
  misc_feature: GYAE6OF01AP3YK.42.41.D08.1.454.CMB.1.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
  modified_base (544)..(550): a, c, t, g, unknown or other
  misc_feature (544)..(550): n is a, c, g, or t
  modified_base (552)..(559): a, c, t, g, unknown or other
  misc_feature (552)..(559): n is a, c, g, or t
  modified_base (561)..(567): a, c, t, g, unknown or other
  misc_feature (561)..(567): n is a, c, g, or t
  modified_base (569)..(574): a, c, t, g, unknown or other
  misc_feature (569)..(574): n is a, c, g, or t
  modified_base (576)..(576): a, c, t, g, unknown or other
  misc_feature (576)..(576): n is a, c, g, or t
  modified_base (578)..(583): a, c, t, g, unknown or other
  misc_feature (578)..(583): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatcgtaggaaatgaacaatcgtgggacgccgaggacacggctgtctatttcngtagtaaaagntcgtgggcgtacaggtttcgttgactacgtgggtcacgggaccctggccaccgtctcctcacgtccctccaaccgaacgggccctagttccggtccctttaccccccgtgggcccctccccgtgccctacccgaacgggtaccgccaccccgtccggaagaccgtccaaccgccggcccggtccccgtaggggtcctcggccccgttagggtaccgaaacggtcccttacgttacccgaatacgttacggcctagtcggacgggccggtcgtacggaccgtaaagggcccgtaacgtanacggtnacgntacgctnannnnnnncnnnnnnnncnnnnnnngnnnnnncncnnnnnn

SEQ ID NO: 149131 - DNA, 828 bp, Homo sapiens
  misc_feature: GYAE6OF01DNDJ2.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtcgtggtctactggacagtcgatcatctactttcctactagtttcggtacctgactagttgtagttttgggggacttaagtttaaccgtttactttccgtaccaggaccgaccggggacccctaacgttccttacgttagtttttaggacgggtactaggtcgggtaccggggtccctacggtacggttcccgtttggtcggtccggtccgtttaccggtacggttccgtacggaccggtaccggtacgggtccccttaccgacgtaacccaacggttcccgtaccggtaacccgtacgtaccggtacgttaaccggaaccgttaacggttacggttacggttaacgttcggttaacgtttccggaccgttccttacgtacgtcggtccgtaacgtaccgtaagttcggtacggtaacttcggtttacccggacccttaccgtaactaaccgtttaacgtccgttccggttaaccgtacccttaccgggtaagtaccgttaacgggaaaccggtccgttaaacgtaccgttaagttttacggttaacgtttaccggttagttaacgtttaagttacggttataccgttaacctattaccgttactacgttcccgttacgtacgttaccgaccgtaccaggttccctcccgtcccgttaccg

SEQ ID NO: 149132 - DNA, 545 bp, Homo sapiens
  misc_feature: GYAE6OF01BK4V0.42.41.D08.1.454.CMB.1.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (508)..(522): a, c, t, g, unknown or other
  misc_feature (508)..(522): n is a, c, g, or t
  modified_base (524)..(524): a, c, t, g, unknown or other
  misc_feature (524)..(524): n is a, c, g, or t
  modified_base (526)..(538): a, c, t, g, unknown or other
  misc_feature (526)..(538): n is a, c, g, or t
  modified_base (540)..(545): a, c, t, g, unknown or other
  misc_feature (540)..(545): n is a, c, g, or t
tcagtgacgtatgtcacgaccggtgctcgatttagtcacgcgagaaagggaaaggggctggtgtgggtctcagctgttattggtgatgggagtaacacaagatacggggactccggtgaagggccgattcagcatctccagagacaacgccaagaacacgtttgtatcgtaggaaaatgaaacaatcgtggggagccggaggacacggctgtcttatttcngtagtaaaantcgtggggcgtactaggtttcgtttgactacgtggggtacacgggtaaccctggtaccaccgttctacctcacgtccctccaaccgaacgggccctagttccggttcccttcccccgtggtcccgcccctgccttccgaggacnccaccgtcgagacgcacgcggccgccgtggctcgccgtgaccgtaaggtacctacgtaccactactaccgtactaccgtggaccgggcgggtcgtacggacggaacggtccgagtaactggncgtangcatgnnnnnnnnnnnnnnncncnnnnnnnnnnnnncnnnnnn

SEQ ID NO: 149133 - DNA, 522 bp, Homo sapiens
  misc_feature: GYAE6OF01B32AC.42.41.D08.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
  modified_base (496)..(522): a, c, t, g, unknown or other
  misc_feature (496)..(522): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctggganccgaggacacggctgtctatttctgtagtaaaaagntcgtgggcggtacaggtttcgtttgactacgtgggtcagggaccctggtcaccgtctctcagcctccacgacggcctagtcggtccttcccccgnggcccgccccgtgcctccgaggcgccaccgtccgaagcgccacgacggccggccccgtggggtcctcggtcccgttacgggtacgtaaaggtacctttaccctacccgaactaccgttacgtcctaacgtcgggacggccggggtctacgggacgtaaacgggccgtactagtacgnnnnnnnnnnnnnnnnnnnnnnnnnnn

SEQ ID NO: 149134 - DNA, 583 bp, Homo sapiens
  misc_feature: GYAE6OF01AZ6HO.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagttttggggctaataacgttatttcccttccagacgacggggcccccaacgtcctcatttttgaggcagtgacggggcctcaggcctttgtgcgctccgagtctggcgacgacgggcctcccgtgacaatcctccggactccaggctgacgacgtacggtgtacttcgtattacgtcgctcatgctgcaagtctgctaattcgccctccgtgaccatcctctgacctcgacgctagaacgacgaacgacgtaacttattacgttagttccgtacttaagttgacgtttcgaacttacgttcagttccgaaccgttccctacgtacacccgtacccgaaggtccctccgtcccccgttaccgg

SEQ ID NO: 149135 - DNA, 831 bp, Homo sapiens
  misc_feature: GYAE6OF01C6TZ0.42.41.D08.1.454.CMB.1.raw
  modified_base (204)..(204): a, c, t, g, unknown or other
  misc_feature (204)..(204): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcagacacagggtcgtggcccagtctgcatccgtgtctgggtctactggacagtcgatcatcacttttcctaacnttggtacctgcagtgtagttttgggctaattaacgtttacttccttccaagtacgacggggccccctaacgtccttacttagtttttggacgggctaggtcggtaccggggacccttcgtacggttccgtttaggtcgtccgtccgttaccggaggttccgtacgggaccgtaccgaccggggtcccttaccccgtagaaccctaacgttccccgtcccggtaaccttaccgacggtaccgtacggtaaccggtaaccgttaaccggtgttaacgtttccggttaaacttttacccggtccgtacttaccgaagttccggtaccttacgtaacccggttaaacgttccggttagggtacccgttaaacgtttttcccgggtaccccttaccccggttaacgaacccttaacgtttccgttacccggttacgtaccccgtaccgtacggtccgtaacggtaaacggtaccgtaaccgaacgttaagtttacgttaggttaacgttaccgtacgtttaaggttacgtacttaaccgttagtaactttcggtactaccggtaaccccgttccgttaaccgttacccgacggtaacccgaccggttaccgtccccgttccccggttaccgg

SEQ ID NO: 149136 - DNA, 1063 bp, Homo sapiens
  misc_feature: GYAE6OF01AKMAZ.42.41.D08.1.454.CMB.1.raw
tcagtgacgtatgtcacgaccggtgctcgatttagtcacgcgagaaagggaaaggggggggttcgacgaacgaggcagcgctctcgggacgtctccaccatgggccctgggctctgctacgtcctccactctccttactcaggacaccaggggtcgtcgggccagtctgcatccgtgtctcggtctactggactagtcgatcatcatttcctacattggtacctgcacgttgtagttttggggcgtattaacgtttacttccgttacccagtaccgacgggggccccctaacggttccgttactacgttttttaggacggggctaacggttaacggaccgggggacccgttccggtaacgggtccccgtttttaggtccgtccggtaccgttacccggtaacgttccggttcgggtcccggtaaccgtaaccgggggttccccttacccccggttacggtaacccgtaaaacgttcccggtttacccggggtaacccttacccggtaacggggtacccgttaacgggggtaaaccccggggtaacggttaaaccccgggggttagggtaaaccggtttttaccggtttaaacggttttaaccccggggttacccggggttaacctttaacccggttaacgttacggttaaccccgttaccgggtaacccgttaaaccgggttacccggttaacggggtaacccgttaaacgttttccggggttacccctttaccccgtaacgggttaaaccttaaccgtttaccgtttacccggttaaccgggttaaccctttacccggtaacgggttacccgttaacgggtaaaccgggttacccgggtaaacccggttaacccggttaacgtttttaaacgggttttaaccgggtttaaaccggttttcccgggtaaccggttttaaacggtttacggtaccgtttaccggttaaccgtaacgttacccgttaagttacccgggttaacccgttacccggttaacccggttccgtaaacccggttacccccggtaaaggttccccgttacccggttccccccggttaccgg

SEQ ID NO: 149137 - DNA, 491 bp, Homo sapiens
  misc_feature: GYAE6OF01AUP1S.42.41.D08.1.454.CMB.1.raw
  modified_base (223)..(223): a, c, t, g, unknown or other
  misc_feature (223)..(223): n is a, c, g, or t
  modified_base (378)..(378): a, c, t, g, unknown or other
  misc_feature (378)..(378): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (471)..(471): a, c, t, g, unknown or other
  misc_feature (471)..(471): n is a, c, g, or t
  modified_base (476)..(491): a, c, t, g, unknown or other
  misc_feature (476)..(491): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgcaagaacacgttgtatctaggaaatgaacaatcgtgggagccgaggacacggctgtctatttctgtagtaaaagntcgtgggcggtactaggtttcgttgacttacgtggggtacaggggaaccctggtccaccgtctcctcacgccctccaaccgtaacgggcccaagtccggtccttaccccccgtggccctcccctgcctcccgaggacgccacccgtcgacggacnctacgacgtccggaccctgggcctgaccctgggtaccaaagtccttaactccanagtaccgtnaacgtggacgcgggctggacaaggcgacgntacgnnnnnnnnnnnnnnnn

SEQ ID NO: 149138 - DNA, 860 bp, Homo sapiens
  misc_feature: GYAE6OF01ARYF1.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacgagggtcgtcgggcccagtctgctactccggtgtcgtgggtctacgtggactagtcgatcatctatttcctactagttcggtacctgctaggttgtagttttggggacgtttaattaaccgttttactttcccgttacccgagtaccggaccggggtaccccctaaacgttcccttacttaggtttttcggacggggtccgtaggtaggggtaccggggtaccctcgtacgggttccgttttggcggtcccgtaccggtccgtacggttccggtcgggaccggacggtaccgggtccccgttacccgtacgtaccgtaaaccgttcccggttacccgaccgtacccgtacgggtccgttacggtaaccgtacggttacgggttacgtttacgtttaaccggtttacgtttacccggttaccggtaccttacggtacgtacggtcccgtttacgaccccgtaggtttccgtacggtaaccgttaacggtttcccgaccccgttacccgtgtaaccctattcccgtcgttaccgcccgtaccgtcgggtactaacggaacgtacggaacgtaagttaccttaaggttacggttacgttacgtttaacgttaaggttacgttaacgttaccgttaactacgttacgtaccgttaccgttacccgtttacctacccggtaccgtacccgtaccggtaaccgtcccgttacccggcccgttcccgg

SEQ ID NO: 149139 - DNA, 687 bp, Homo sapiens
  misc_feature: GYAE6OF01C4MNK.42.41.D08.1.454.CMB.1.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcagacacagggtcgtggcccagtctgcatccgtgtctgggtctactggacagtcgatcatcatttcctacattggtacctgcagtgtattttggggcgtattaacgttatttccttcccagacacggggcccccaacgtcctctattttgagggctagtggacgggccctnacggtcctttgngcgctccgagtcgtggacgacgacgggcctcccgtgacctaactccgtcccggacctccgaggccgtaggaaccgtacgtaccgggtgtacgtttccggtaacgtttaccggtcgtccttacgaacttcgtaccgttcgaccctaagggttcctacggtacgttaaacgtttccggtacccttcccgtagaacctaacttccttacgtcggtacccttccgaagggtcctagggaaccgacggaaccgtaacgtaatttagttagtacgtttacgtatttaaggttgtaactttccgtatattccgattccggtacccgttacctacgtaccgtaccgacccgtaaccgggtcctacccggtcccccgtaccgg

SEQ ID NO: 149140 - DNA, 610 bp, Homo sapiens
  misc_feature: GYAE6OF01A55VG.42.41.D08.1.454.CMB.1.raw
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
tcagtgacgtatgtcacgaccggtgctcgatttagtcacgcgagaaagggaaagggggggtcacaagaggcagcgctctcgggacgtctccaccatggcctgggctctgctactcctcactctccttactcagacacagggtcgtgggcccagtctgcatccgtgtctggtctacgtggacagtcgatcatcactttccatattggtacctgctagtgtagttttggggcttaataacgttctttcctccagccgacgggccccaagtcctctattttgaggtnagtgacggcctcgacgtcttgngtcgctacgtgtcgtcggcacgacggcctccngacatcgtaccgctccgagctcgacgacgtagtgtacgttcgtatacgtcnctcacgtcgctcgacctagtcgtcgtactagttcgtaccctcgtntactatccgtactcgtaacctccggacgtcgtacggtaacgacggtaaccgtacgttatttacgttacgtagtttaccgactttaagtcggtactttcggtaactagtactagttacgtacccttccgtaacgtacccgacgtacccggtaagcccgttcccgtcccgtacccggg

SEQ ID NO: 149141 - DNA, 665 bp, Homo sapiens
  misc_feature: GYAE6OF01ES4KF.42.41.D08.1.454.CMB.1.raw
  modified_base (243)..(243): a, c, t, g, unknown or other
  misc_feature (243)..(243): n is a, c, g, or t
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtggacccagtctgcatccgtgtctgggtctactggacagtcgatcatcaatttccactattggtacctgcagtgtagttttggggcttataacgttntttcctccagacacgggcccccaagtcctcacttttgaggcagtggacgggccctacgacgtcctttgtagtccgcgtccggagttctcgggtccgacgacggggtccctcccgtagaccaactccgtacccggacctccgaggtcctggaacgtacgtaccggtagtacgttcgttaacttcggtcgtactctagtcgtcgttacgacctaacgttcgtacgtacttaacgttttcggaccttccccgtagaaccttaacgttccttacgtacggaccttcgacgtacgaggtaaacgaccgtaacgtaacgtattaacgttagtacgtttcgaactttagttgtacttagtaactacttcagttaccctccggttcctacgtacgtaacgcccgtaaagtccgtcccgtcccctaccggg

SEQ ID NO: 149142 - DNA, 868 bp, Homo sapiens
  misc_feature: GYAE6OF01E1FYW.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctatattcggtacctgctagtgtagttttgggacgttattaacgtttatttcccttacccaggacgaccggggccccccaacgttccctctatttttggagggcaggtgacggggccctcgaggtcctttgtcgcgcgtccgagttcgtggcgtaccgagggtccctacccgtgacctaacgtcctcccggacctccgacggtccgtacgaaccgtacgttacgggtcgtacgtttaccggttaacgtttaccgttcccggacctttaccgtacgttcggtccctttacggggccccgttaaacggtttccggttacgggtaccttaaaccgggtttttacccggtacccccgtttacccccggtacggtaaaccctaacccgtttccgttaccgttcccgggtaacccttccccgggtaacgggttaccgtttaacgggaaaccggaaccccgggttaaccgtaaccggttttaacgtttaacgttttaacggttttacggttttaaccggttaacgttttaacggtttacggttattttaacccgggttaacttacggtttccctaacggttacccggttaaccccgtttacccgttaacgttaccccgtaaccgggtaccccgtaaagggtccccgtttacccccggccccccccggtttaccggg

SEQ ID NO: 149143 - DNA, 571 bp, Homo sapiens
  misc_feature: GYAE6OF01BSX2W.42.41.D08.1.454.CMB.1.raw
  modified_base (226)..(226): a, c, t, g, unknown or other
  misc_feature (226)..(226): n is a, c, g, or t
  modified_base (382)..(382): a, c, t, g, unknown or other
  misc_feature (382)..(382): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (536)..(551): a, c, t, g, unknown or other
  misc_feature (536)..(551): n is a, c, g, or t
  modified_base (553)..(571): a, c, t, g, unknown or other
  misc_feature (553)..(571): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatcgtgggagccggaggacacggctgtcttatttctgtagtaaaaagntcgttaggggccggttacagggtttcgttttgaccttaggtggggtcaaggggtaaccctggtaccaccgtctccctcacgtccctccaccgaacgggcccaagttcccgggtacccttccccccgtgggcccgtcccctgccctccggacggacncccacccgtccggagacgccacgacggccccggcccgtgggcctggccgttcgggtacgaaacggtacctttacccttccgacctaacgtaccgtaccacgttcggacgggccgggtcgtcggaacgacggggtccactaatcggnactnacgnnnnnnnnnnnnnnnncnnnnnnnnnnnnnnnnnnn

SEQ ID NO: 149144 - DNA, 668 bp, Homo sapiens
  misc_feature: GYAE6OF01CEJ9R.42.41.D08.1.454.CMB.1.raw
tcagtgacgtatgtcacgaccggtgctcgatttagtcacgcgagaaagggaaagggggggtcacaagaggcagcgctctcgggacgtctccaccatggcctgggctctgctactcctcactctccttactcaggacacgagggtcgtcgggcccagtctgcatccgtgtctgggtctacgtggacagtcgatcatctactttcctactagttcggtacctggactagttggtagttttggggcttaattaacgtttactttccttaccacgacgaccgggaccccaacgtccttacgttacgttttggacggtcgtagtcggacgggtcctacgtcggtccgtttgtcgcgtcgtcgtacgtcgtcggcgacgtacggcctaccgtacgaactaacgtccgtaccggtactacgacggtcgtacgacgtacgtacggtcgtacgttcgtacgttacgtcgctctacgtcgcgtcgacgtagtcgtagtactacgttcgcctccgtataactatccgtctcgtactcgacgtcgtacgaacgacgacgtagtacgttaattacggtacttacgtacgtttaacgtcgtacttacgtacgtacgttctagttaccgtcccgttacgtacgtacgtaaccgaccgtacggtccctcccggtcccttaccgg

SEQ ID NO: 149145 - DNA, 919 bp, Homo sapiens
  misc_feature: GYAE6OF01AW5FT.42.41.D08.1.454.CMB.1.raw
tcagtgacgtatgtcacgaccggtgctcgatttagtcacgcgagaaaggggaaaggggggggtcacaagaggcagcgctctcgggacgtctccaccatggcctgggctctgctactcctcactctccttactcaggacacagggtcgtcgggcccagtctgcatccgtgtcgtcgggtctacgtggacagtcgatcacttctactttcctactagttcggtacctgactaggtgtgtttcgggacttattaacgtttctttccgtacccgagaccggacccggggtaccccctaacgttccttaccttaggttttcggacgggtacgtagggtcgggacccggggtcccttcggtaccgggttccgtttggtaccggccggtccgtaccgggtacgttccggtcgggtacccggtaccggtaccgggtacccttcccgtacggaaccttaaccgttcccgtacccgggtacctaccgggtaccggacgtaaccggtaaccggtacggttacggtacgtttaacggtttaccggttaacgtttccggtaccggtccttacgtcgtaccggttccgtacggtaccgtacggttcgtacgggtacctttacggttccccggtccctaccgtactaacccgtactttccggtacgttaccggtaacccgtccgtagggtacccgtaaagggaacccggtaccggttaaacggttaccggttaaagtttttaccggttaacgggttttaccgtttaacggttacgtttaaacgggtttccgttaacctttaaggtttacccgttacgtttcccgttaaccgggttacccggttaacccgttacccggttaacccgtacccgtaaacccgggttcccggtaacccccgggtcccggttaccccccggtttcccccggttacccgg

SEQ ID NO: 149146 - DNA, 579 bp, Homo sapiens
  misc_feature: GYAE6OF01AXV8M.42.41.D08.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (524)..(525): a, c, t, g, unknown or other
  misc_feature (524)..(525): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(540): a, c, t, g, unknown or other
  misc_feature (539)..(540): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (553)..(556): a, c, t, g, unknown or other
  misc_feature (553)..(556): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (564)..(566): a, c, t, g, unknown or other
  misc_feature (564)..(566): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (575)..(579): a, c, t, g, unknown or other
  misc_feature (575)..(579): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgcaagaacacgttgtatctggaaatgaacaatctggganccgaggacacggctgtctatttctgtgtaaaagntctgggcgtacaggtttcgtttgactacgtggggtcagggacccctggtccaccgtctcctcagcctccaccaacgggcccatccggtcttccccccgtggccgccccttgcctccaggacgccacccgtcgacgacgccacgtacgccggccccgtggggcctacgcccgttcggggtaccaaacggggaaccttaccgtttccccaaccgaacttaacccggttcctaacgttacggaaggtcccggggtaccttcggggaccaaaggggtccgaccgaacttacgngacncgacgctagcnnccgancancncncnncacgcnncncacnnnncncgcnannncgncncacnnnnn

SEQ ID NO: 149147 - DNA, 668 bp, Homo sapiens
  misc_feature: GYAE6OF01ECN1A.42.41.D08.1.454.CMB.1.raw
  modified_base (230)..(230): a, c, t, g, unknown or other
  misc_feature (230)..(230): n is a, c, g, or t
  modified_base (614)..(614): a, c, t, g, unknown or other
  misc_feature (614)..(614): n is a, c, g, or t
  modified_base (619)..(620): a, c, t, g, unknown or other
  misc_feature (619)..(620): n is a, c, g, or t
  modified_base (623)..(623): a, c, t, g, unknown or other
  misc_feature (623)..(623): n is a, c, g, or t
  modified_base (632)..(634): a, c, t, g, unknown or other
  misc_feature (632)..(634): n is a, c, g, or t
  modified_base (638)..(640): a, c, t, g, unknown or other
  misc_feature (638)..(640): n is a, c, g, or t
  modified_base (642)..(645): a, c, t, g, unknown or other
  misc_feature (642)..(645): n is a, c, g, or t
  modified_base (647)..(649): a, c, t, g, unknown or other
  misc_feature (647)..(649): n is a, c, g, or t
  modified_base (651)..(653): a, c, t, g, unknown or other
  misc_feature (651)..(653): n is a, c, g, or t
  modified_base (655)..(656): a, c, t, g, unknown or other
  misc_feature (655)..(656): n is a, c, g, or t
  modified_base (658)..(668): a, c, t, g, unknown or other
  misc_feature (658)..(668): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagacgacaacgccaagaacacgttgtatctaggaaatgaaacaatcgtgggacgccgaggacacggctgtcttatttcgtgtaagtaaaagngttcgtggggaccgttaacgtaggttttccgtttgaccgttacggtcggggtaccgaaccggggtaaccgttcggtacctacccggttcctcctcgaccgtcccctaccgaacccggtaaccggccctacgtttcccgggttccccttccccccgtgggaccccgtccccttcggcccttaccggacggtacccgaccctaccccgtacggacgaccggtcaaccggtccggtacccggtcccggtcggggtcctaccgggtcccgttaacgggtaaccgaacggtaacccttttacccgttaacaaccgttaacttcccggacgtaacggtcgggacggtccgggagtacgggacccggacggttaccggataacgggtacgngtgannagncgacgtgcnnntcgnnntnnnncnnncnnngnncnnnnnnnnnnn

SEQ ID NO: 149148 - DNA, 548 bp, Homo sapiens
  misc_feature: GYAE6OF01BZIPN.42.41.D08.1.454.CMB.1.raw
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
  modified_base (503)..(503): a, c, t, g, unknown or other
  misc_feature (503)..(503): n is a, c, g, or t
  modified_base (508)..(510): a, c, t, g, unknown or other
  misc_feature (508)..(510): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(548): a, c, t, g, unknown or other
  misc_feature (517)..(548): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaaagaacacgttgtatctggaaatgaacaatcngggagccgaggacacggctgtctatttctgtagtaaaagntctggggcggtacaggttcgtttgactacgttggggtcagggaccctggtccgaccgtctccctcacgcctccgaccgaacgggcccaatccgggtccttccccccgtggcccgcccctcgcctcccgacggacgccgacccgtcccgaggacgcctaccgacggccgccccgtgggcctggccgtcggtacgaacggtactcccgttaccgacacgttccgtacaccgtgacggtccggggcgtcgggacgtaaccgggccggactaacggagtagccngacgnnngnanncnnnnnnnnnnnnnnnnnnnnnnnnnnnnnnnn

SEQ ID NO: 149149 - DNA, 491 bp, Homo sapiens
  misc_feature: GYAE6OF01CQ6W4.42.41.D08.1.454.CMB.1.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
  modified_base (469)..(491): a, c, t, g, unknown or other
  misc_feature (469)..(491): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagcgaggacacggctgtctattctgtagaaaagntgtgggcgtataggttcgttgactaggtgggtcagggaccctggtccacgtctcncncncctccacgacggcctacgtccgtccttcccccgtgcccgcccgtcgcctccgacgcgacccnccgtcgagacgaccacgccggccggcccgtcggcgtcgtcccgtggtacgaacgtacctaccttaccaactccgtaactcncgtacgggcggtaccgggtcgtacggnggtaacgccgtacgatgcntnnnnnnnnnnnnnnnnnnnnnnn

SEQ ID NO: 149150 - DNA, 636 bp, Homo sapiens
  misc_feature: GYAE6OF01CX7BH.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctcctactcaggacacgagggtcgtgggcccagtctgcatccgtgtcgtgggtctacgtggacagtcgatcatctatttcctactattggtacctgctagtgtagttttggggcttaattaacgtttactttcctccgagaccgacgggccccaacgtcctcttagttttgaggcaggtgacggggtccctcgacggtcctttggtgcgtccgtcgagtcgtggcgacgacggcctcctagacagtcctaccggactcgagctcgaaccgtcgtacggtctacgtttcgtaattacgtcgtctcatcgctcgacctagtcgtagtacttacgttcgcccttccgtagtactacttcgtacgtcggacctcgacgtacgtacgtaacgaacgtaacgtaagtactttagtacgttacgttacgtatttaaggttctacttaccgtatacgttcgtacttcgtacccgttacgttacgactaccgacccgaggttcccgtcccgtcccccgtacgg

SEQ ID NO: 149151 - DNA, 805 bp, Homo sapiens
  misc_feature: GYAE6OF01CKZ2V.42.41.D08.1.454.CMB.1.raw
tcagtgacgtatgtcacgaccggtgctcgatttagtcacgcgagaaagggaaagggggggtcacaagaggcagcgctcgtcgggacgtctccaccatggcctgggctctgcctactcctcactctcctactcaggacacgagggtcgtcggcccagtctgcatccggtgtcgtgggtactacgtggacagtacgatcaatcctaactttcctaactagttacggtaccgtgacctaaggttgtaggttttcggggacttaagtttaaacgtttactttcccgtaccgaacggaccgggaaccggggtacccccctaaggttacccgttaccgtttaacggtttttaaggaacggggtacgtaacgggtacgggtaaccggggtacccctacggttaacggttccccgtttagggtccggtaccgtccgttacgttacggtagttaccggtacggacccggtaaccgtaccgggtacccctacccgtaacgaacgtacctccggtacccggtactaccggcgtacgtacggacgtaccgtaggtacgtaacgttcgtacgttacgcgtacgtacgtacgttacgactcgaacgtagtcgtagtacttaacgttccgtccctaccgtacgtaactacttacgtaccgtacgtaccgaccgtagtaaccgtaggtaaaccgaccggtaacgtaacgtaattacgtttaacgtaacgttagtaacgttaagttacacgttacgtaactcgtaatacctcgacccgttacgtaccgtacaccggtacgaacgttcccgcccggttacccg

SEQ ID NO: 149152 - DNA, 779 bp, Homo sapiens
  misc_feature: GYAE6OF01BJ97F.42.41.D08.1.454.CMB.1.raw
  modified_base (243)..(243): a, c, t, g, unknown or other
  misc_feature (243)..(243): n is a, c, g, or t
  modified_base (750)..(750): a, c, t, g, unknown or other
  misc_feature (750)..(750): n is a, c, g, or t
  modified_base (765)..(765): a, c, t, g, unknown or other
  misc_feature (765)..(765): n is a, c, g, or t
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
  modified_base (778)..(778): a, c, t, g, unknown or other
  misc_feature (778)..(778): n is a, c, g, or t
tcagtgacgtatgtcacgaccggtgctcgatttagtcacgcgagaaaggggaaagggggggtcacaagaggcagcgctcgtcgggacgtctccaccatggcctggctctgctacctcctcacctccttccttactcgacggacgacgtacgggtcggtcgggcccagttctgctacgtcccggttgtcgtcggttactacgtcggacagtcgactcatctactttcctactacttcggtaccngcgtagtgttacggttcggacgttacgttaacgtttccttcccgtaccgacggaccggacccgggtccccctaacgttcctacgttagtttaggacggtcgtaggtacggtaccggtcccgtacggtaccgttccgtttcggtcgccgtccgtacgtaacgtcgttacggtacttacggttccgtccctccgtacgtactactctacgtacgtacctaccgtacgtcgtacgtaacgaccgtacgtaacttaacgtttacgttagtttacggtttccgttaacgttttaacgtggttaacgttacgttacttacgttacgttacgtaccgttaccgttaccgtaccgtaccgaccgacccgtaccgtcccggtccccgtcccggttcccgttaccttcccgttcccgttacccttccctacccgtacctaccgtacgtaccgttaccgtaccgtacgaccggcggtcggtaccggtaccggtacggacgtaccgtaccgacgtcacnggggggggggggtcncgactcncncgtna

SEQ ID NO: 149153 - DNA, 637 bp, Homo sapiens
  misc_feature: GYAE6OF01ADZ1R.42.41.D08.1.454.CMB.1.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (440)..(440): a, c, t, g, unknown or other
  misc_feature (440)..(440): n is a, c, g, or t
  modified_base (579)..(579): a, c, t, g, unknown or other
  misc_feature (579)..(579): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (633)..(633): a, c, t, g, unknown or other
  misc_feature (633)..(633): n is a, c, g, or t
tcagtgacgtatgtcacgaccggtgctcgatttagtcacgcgagaaagggaaagggctggtgtggtctcagctgttattggtgatgggagtaacacaagatacggggactccggtgaagggccgattcagcatctccagagacaacgccaagaacacgttgatacgtaggaaactgaacaatcgtgggacgccgagacgagcgtgtctagtttcngtagtaaaagctcgtagggcgttaacgngggttttcttaggaaccttacgtgggttacaacgggtaaccctgggtcctaaccgttctcctacgacgtccctccaaccgaaacgggccctaacgttccgggtccctttcccccgtgggacccgtccccgtggtaccctccgaaggtaaccgccgtaccgacccggaagacgcgtaaaccggacgcgggtaacccgngggaccttcggtccgtaggtacaaacggtacttacccggttccaagtacctaacggctaacggtgtaacgggcggtacgttacgcgaacggtccgaacgttacgacggactagacgttagctacggacagcgcttaagnaccaggcctgctgcgaanangagnnancgatcnangcgcgagtctctancnngngacg

SEQ ID NO: 149154 - DNA, 590 bp, Homo sapiens
  misc_feature: GYAE6OF01A2U9A.42.41.D08.1.454.CMB.1.raw
  modified_base (229)..(229): a, c, t, g, unknown or other
  misc_feature (229)..(229): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (554)..(556): a, c, t, g, unknown or other
  misc_feature (554)..(556): n is a, c, g, or t
  modified_base (558)..(590): a, c, t, g, unknown or other
  misc_feature (558)..(590): n is a, c, g, or t
tcagtgacgtatgtcacgaccggtgctcgatttagtcacgcgagaaaggggaaaggggctggtgtgggtctcagctgttattggtgatgggagtaacacaagatacggggactccgtgaagggccattcagcatctcagagacaacgccaagaacacgttgtatcgtaggaaatgaaacaatcgtggggagccggaggacacggctgtcttatttctgtagtaaaaagntcgtggggccggttaactagggttttccgtttagaccttacggttgggggtcaacgggtaaccctggtccacccgtctcctcacgccctccaccgaacgggccctacgtccggtccttcccccgtcggcccgcccctcgcctttccgacggtacgccgtacccgtccggacggacgacgaaccacggcccgggcccggtcgggccgtaccggtcccgttacgggtccgaaacgggtacctacccgtttacccaacgtacgttacgtaccacgtagtacggcgggtcgtagggaccgtaacgggcgacgtacgtagcgancgnngnnngnnnnnnnnnnnnnnnnnnnnnnnnnnnnnnnnn

SEQ ID NO: 149155 - DNA, 574 bp, Homo sapiens
  misc_feature: GYAE6OF01EUMWK.42.41.D08.1.454.CMB.1.raw
  modified_base (187)..(187): a, c, t, g, unknown or other
  misc_feature (187)..(187): n is a, c, g, or t
  modified_base (280)..(280): a, c, t, g, unknown or other
  misc_feature (280)..(280): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (539)..(541): a, c, t, g, unknown or other
  misc_feature (539)..(541): n is a, c, g, or t
  modified_base (543)..(574): a, c, t, g, unknown or other
  misc_feature (543)..(574): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctggganccgaggacacggctgtctattttctgtgttaaaaacggatactggggacggtacaagggtttcgttttgactaacgtggggtcagggaacccnggttccaccgtctaccgtcagcctccaccaacgggcccatccggtaccttcccccctggcccgcccctagctcccaaggacgtccgaaccctcccggaagacgactacgacgtaccgggccccttggggaccttcgaccgtcggtacgaaagggtaaccccttcggtttaccccaccctaaataccggttaccaaccttgggaacgcgggggtacccgtggacccgaagggaccggtacacggttaacgngcnggangnnncnnnnnnnnnnnnnnnnnnnnnnnnnnnnnnnn

SEQ ID NO: 149156 - DNA, 683 bp, Homo sapiens
  misc_feature: GYAE6OF01BGE7P.42.41.D08.1.454.CMB.1.raw
tcagtgacgtatgtcacgaccggtgctcgatttagtcacgcgagaaagggaaggggggggtcacaagaggcagcgctctcgggacgtctccaccatggcctgggctctgctactcctcactctccttactcacggacacagggtcgtgggcccagtctgcatccgtgtctgggtctactggactagtcgatcatcatttccctacgatttggtacctgcagtgtagttttgggggctattaacggttattcccttccgagtacgacgggggtccccctaagtccctctaagtttttcgagggtcacggttggacggggtccctcgacggtccgtttagtgtccgaccgttccggagttcgtaggccggacacgggtccctccgtacgactaaacgtcctaccggacttaccgacggcgtacgacgtacgtacggtgtacttcgtattaccgtcgtcgtacgtatcgctacgtaccgtaacgtcgtacggtactaacggtttcgacccgttaccgtacgtacctacgttacctacgttcggtacctacggtacgcggttaacgaacgtaccgtacgtaacggtattaacgttacgtacgttcgtacgttacgttgtacgtcgtaacgtacgttcgtacgtcgtaccttacacgtacctacgaccgaagtcctccgtcccgtccg

SEQ ID NO: 149157 - DNA, 744 bp, Homo sapiens
  misc_feature: GYAE6OF01A8JLG.42.41.D08.1.454.CMB.1.raw
  modified_base (241)..(241): a, c, t, g, unknown or other
  misc_feature (241)..(241): n is a, c, g, or t
  modified_base (695)..(695): a, c, t, g, unknown or other
  misc_feature (695)..(695): n is a, c, g, or t
  modified_base (699)..(700): a, c, t, g, unknown or other
  misc_feature (699)..(700): n is a, c, g, or t
  modified_base (705)..(705): a, c, t, g, unknown or other
  misc_feature (705)..(705): n is a, c, g, or t
  modified_base (707)..(709): a, c, t, g, unknown or other
  misc_feature (707)..(709): n is a, c, g, or t
  modified_base (711)..(714): a, c, t, g, unknown or other
  misc_feature (711)..(714): n is a, c, g, or t
  modified_base (717)..(717): a, c, t, g, unknown or other
  misc_feature (717)..(717): n is a, c, g, or t
  modified_base (719)..(744): a, c, t, g, unknown or other
  misc_feature (719)..(744): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagacgacaacgccaagaacacgttgtatcgtaggaaatgaaacaatcgtgggacgccggaggaccacgggctgttactttatttcgtaggttaagtaaaacgnttcgtcgggggtacggttaacctgggttttccgtttacgaaccgtttaccgggtcgggggtaccgaacgggtaaccccgttggtacccgtaccgttccgttcccgtaccgaccgtcccctaacccggtaacccggtaaacccggggcccccttaacgggttccccggtttcccccccgttttcccccccgggtcggggtccccccgtttaccccccgcgggtaaccccgttacccggtaaccggggacccgtacccggtaacccccggtaccgggaaacggacccgtaaccgaccccgggtaacccgggccccggtccccgggttcgggtaccgtccggtcccgttacggggtaaacctaacggtacccttttaccgtaccaacgtaaccgtttacgaccgttacgcgggtaccggtccgggacggtacggaggaaccggcgtaaccgatagcntacnncagcncnnncnnnncancnnnnnnnnnnnnnnnnnnnnnnnnnn

SEQ ID NO: 149158 - DNA, 526 bp, Homo sapiens
  misc_feature: GYAE6OF01AVOG5.42.41.D08.1.454.CMB.1.raw
  modified_base (134)..(134): a, c, t, g, unknown or other
  misc_feature (134)..(134): n is a, c, g, or t
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
  modified_base (391)..(391): a, c, t, g, unknown or other
  misc_feature (391)..(391): n is a, c, g, or t
  modified_base (480)..(481): a, c, t, g, unknown or other
  misc_feature (480)..(481): n is a, c, g, or t
  modified_base (486)..(489): a, c, t, g, unknown or other
  misc_feature (486)..(489): n is a, c, g, or t
  modified_base (491)..(497): a, c, t, g, unknown or other
  misc_feature (491)..(497): n is a, c, g, or t
  modified_base (499)..(513): a, c, t, g, unknown or other
  misc_feature (499)..(513): n is a, c, g, or t
  modified_base (515)..(526): a, c, t, g, unknown or other
  misc_feature (515)..(526): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaaggcgattcagcatcnccagagacaacgccaaagaactacgttgtatctaggaaaatgaaacaatccgtggggaancccggaggacacggctgtctatttcgtgtagtaaaaagtcgtggggacgtanaggtttcttgactacgtggggtacagggacctggcaccgtctcctcacgtcctccaaccgaagggcccagtccggtccttacccccgtggccgtcccctgcctccgagaccgcaccctccggagacgcaacgagccggtacccgnggcctcgccgtcggtacaaacggacctactaccactacgtacgtacgatcggaacggcgggtctaggacgaaacgggctacgaagacgnncgaannnnannnnnnnannnnnnnnnnnnnnnannnnnnnnnnnn

SEQ ID NO: 149159 - DNA, 421 bp, Homo sapiens
  misc_feature: GYAE6OF02H9TDM.42.41.D08.1.454.CMB.1.raw
  modified_base (416)..(421): a, c, t, g, unknown or other
  misc_feature (416)..(421): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctcaccaagggcccatcggtcttcccctggcgcccctgctcccaggagcacctccgagagcacagcggcctgggctgcctggtcaaggactacttccacatacgtcactgagcgggctggcaaggcgcatagnnnnnn

SEQ ID NO: 149160 - DNA, 418 bp, Homo sapiens
  misc_feature: GYAE6OF02G2NQM.42.41.D08.1.454.CMB.1.raw
  modified_base (414)..(418): a, c, t, g, unknown or other
  misc_feature (414)..(418): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcgtacaggttcgttgactactggggtcagggaaccctggtcaccgtctcctcagcctccaccaaggcccatcggtcttccccctggcgccctgctccaggagcacctccgagagcacagcggccctgggctgcctggtcaaggactacttcacatacgtcactgagcgggctggcaaggcgcatagnnnnn

SEQ ID NO: 149161 - DNA, 411 bp, Homo sapiens
  misc_feature: GYAE6OF02J3HOM.42.41.D08.1.454.CMB.1.raw
  modified_base (219)..(219): a, c, t, g, unknown or other
  misc_feature (219)..(219): n is a, c, g, or t
  modified_base (406)..(411): a, c, t, g, unknown or other
  misc_feature (406)..(411): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctattctgtgtaaaagntctgggcgtacaggttcgttgactactggggtcagggaccctggtcaccgtctcctcagcctcaccaaggcccatcggtctcccctgcgccctgctccaggagcacctccgagagcacagcggccctgggcctgcctggtcaaggctacttccacatacgtcactgagcggctggcaggcgcatagnnnnnn

SEQ ID NO: 149162 - DNA, 421 bp, Homo sapiens
  misc_feature: GYAE6OF02HTNR9.42.41.D08.1.454.CMB.1.raw
  modified_base (221)..(221): a, c, t, g, unknown or other
  misc_feature (221)..(221): n is a, c, g, or t
  modified_base (415)..(421): a, c, t, g, unknown or other
  misc_feature (415)..(421): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttcccctggcgccctgctccaggagcacctccgagagcacagcggcctgggctgcctggtcaaggctacttccacatacgtcactgagcgggctggcaaggcgcatagnnnnnnn

SEQ ID NO: 149163 - DNA, 417 bp, Homo sapiens
  misc_feature: GYAE6OF02IUUWC.42.41.D08.1.454.CMB.1.raw
  modified_base (413)..(417): a, c, t, g, unknown or other
  misc_feature (413)..(417): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcgtacaggttcgttgactactggggtcagggaaccctggtcaccgtctcctcagcctccaccaagggcccatcggtcttccccctggcgccctgctccaggagcacctccgagagcacagcggccctgggctgcctggtcaaggctacttcacatacgtcactgagcgggctggcaggcgcatagnnnnn

SEQ ID NO: 149164 - DNA, 420 bp, Homo sapiens
  misc_feature: GYAE6OF02IMMZ8.42.41.D08.1.454.CMB.1.raw
  modified_base (417)..(420): a, c, t, g, unknown or other
  misc_feature (417)..(420): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggctacttccacatacgtcactgagcgggctggcaaggcgcatagnnnn

SEQ ID NO: 149165 - DNA, 430 bp, Homo sapiens
  misc_feature: GYAE6OF02HHBK7.42.41.D08.1.454.CMB.1.raw
  modified_base (221)..(221): a, c, t, g, unknown or other
  misc_feature (221)..(221): n is a, c, g, or t
  modified_base (417)..(417): a, c, t, g, unknown or other
  misc_feature (417)..(417): n is a, c, g, or t
  modified_base (423)..(430): a, c, t, g, unknown or other
  misc_feature (423)..(430): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggccccatcggtcttccccctggccgcccctgcctccaggacgcacctccgagacgcacagccggccctgggctgcctggtcaaggctacttccacatacgtcactgagcggctggcaaggcncatagnnnnnnnn

SEQ ID NO: 149166 - DNA, 433 bp, Homo sapiens
  misc_feature: GYAE6OF02I4HHF.42.41.D08.1.454.CMB.1.raw
  modified_base (221)..(221): a, c, t, g, unknown or other
  misc_feature (221)..(221): n is a, c, g, or t
  modified_base (421)..(433): a, c, t, g, unknown or other
  misc_feature (421)..(433): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactactggggtcagggaaccctgggtcaccgtctcctcagcctccaccaagggccccatcggtcttccccctggccgccctgctccaggagcacctccgagagcacagcggccctgggctgcctggtcaaggactacttccacatacgtcactgacgcgggctggcaaggcgcatagnnnnnnnnnnnnn

SEQ ID NO: 149167 - DNA, 534 bp, Homo sapiens
  misc_feature: GYAE6OF02I90MK.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgtataacgttatttccttcccagacaggggcccccaacgtcctcatttttgagggcagtgaggggccctcaggcctttgtgcgctccgagtctggcgacagggcctccctgacaatctccggactccaggctgacgactacggtgattcgtattacgtcgctcatgctgccaagtctggcaatttggcctcctgacatctctgactccagctgaagacgacgacgattattagtagttcgcttaagttgattcgtacattcattcgaccgttcctacgtcacgcccaaggcctcgcccccgtcgg

SEQ ID NO: 149168 - DNA, 419 bp, Homo sapiens
  misc_feature: GYAE6OF02FGSVE.42.41.D08.1.454.CMB.1.raw
  modified_base (221)..(221): a, c, t, g, unknown or other
  misc_feature (221)..(221): n is a, c, g, or t
  modified_base (417)..(419): a, c, t, g, unknown or other
  misc_feature (417)..(419): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttccccctgcgccctgctccaggagcacctccgagagcacagcggccctgggctgcctggtcaaggactacttccacatacgtcactgagcgggctggcaaggcgcatagnnn

SEQ ID NO: 149169 - DNA, 419 bp, Homo sapiens
  misc_feature: GYAE6OF02HFSRL.42.41.D08.1.454.CMB.1.raw
  modified_base (417)..(419): a, c, t, g, unknown or other
  misc_feature (417)..(419): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaaggcccatcggtcttccccctggcgccctgctccaggagcacctccgagagcacagccggccctgggctgcctgtcaaggactacttccacatacgtcactgagcgggctggcaaggcgcatagnnn

SEQ ID NO: 149170 - DNA, 426 bp, Homo sapiens
  misc_feature: GYAE6OF02IWBVZ.42.41.D08.1.454.CMB.1.raw
  modified_base (221)..(221): a, c, t, g, unknown or other
  misc_feature (221)..(221): n is a, c, g, or t
  modified_base (420)..(426): a, c, t, g, unknown or other
  misc_feature (420)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaaggccccatcggtcttccccctggcgccctgctccaggagcacctccgagagcacagcggccctgggcctgcctggtcaaggactacttccacatacgtcactgagcgggctggcaagggcgcatagnnnnnnn

SEQ ID NO: 149171 - DNA, 422 bp, Homo sapiens
  misc_feature: GYAE6OF02JEQ3U.42.41.D08.1.454.CMB.1.raw
  modified_base (221)..(221): a, c, t, g, unknown or other
  misc_feature (221)..(221): n is a, c, g, or t
  modified_base (412)..(412): a, c, t, g, unknown or other
  misc_feature (412)..(412): n is a, c, g, or t
  modified_base (418)..(422): a, c, t, g, unknown or other
  misc_feature (418)..(422): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaaccctggtcaccgtctcctcagcctccaccaagggcccatcggtcttccccctgaccgccctgctccaggagcacctccgagagcacagcggccctgggctgcctggtcaaggctacttccacatacgtcactgagcgggctggcaaggcncatagnnnnn

SEQ ID NO: 149172 - DNA, 418 bp, Homo sapiens
  misc_feature: GYAE6OF02G1UAQ.42.41.D08.1.454.CMB.1.raw
  modified_base (221)..(221): a, c, t, g, unknown or other
  misc_feature (221)..(221): n is a, c, g, or t
  modified_base (416)..(418): a, c, t, g, unknown or other
  misc_feature (416)..(418): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgttgactactggggtcagggaccctggtcaccgtctcctcagcctccaccaagggccccatcggtcttccccctggcgccctgctccaggagcacctccgagagcacagcggccctgggctgcctggtcaaggctacttccacatacgtcactgagcgggctggcaaggcgcatagnnn

SEQ ID NO: 149173 - DNA, 427 bp, Homo sapiens
  misc_feature: GYAE6OF02IBVBQ.42.41.D08.1.454.CMB.1.raw
  modified_base (222)..(222): a, c, t, g, unknown or other
  misc_feature (222)..(222): n is a, c, g, or t
  modified_base (413)..(413): a, c, t, g, unknown or other
  misc_feature (413)..(413): n is a, c, g, or t
  modified_base (418)..(427): a, c, t, g, unknown or other
  misc_feature (418)..(427): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntctgggcggtacaggtttcgtttgactacgtggggtcagggaaccctggtcaccgtctcctcagcctccaccaagggcccatcggtcttccccctggcgccctgctccaggagcacctcgagagcacagcgcctgggctgcctggtcaaggctacttccactatacgtcactgagcgggctggcaaggcgnatagnnnnnnnnnn

SEQ ID NO: 149174 - DNA, 423 bp, Homo sapiens
  misc_feature: GYAE6OF02ISF4C.42.41.D08.1.454.CMB.1.raw
  modified_base (221)..(221): a, c, t, g, unknown or other
  misc_feature (221)..(221): n is a, c, g, or t
  modified_base (416)..(423): a, c, t, g, unknown or other
  misc_feature (416)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaccctggtcaccgtctcctcagcctccaccaagggcccatcggtcttccccctggcgccctgctccaggagcacctccgagagcacagcggcctgggctgcctggtcaaggactacttccacatacgtcactgagcgggctggcaaggcgcatagnnnnnnnn

SEQ ID NO: 149175 - DNA, 423 bp, Homo sapiens
  misc_feature: GYAE6OF02FVHJA.42.41.D08.1.454.CMB.1.raw
  modified_base (221)..(221): a, c, t, g, unknown or other
  misc_feature (221)..(221): n is a, c, g, or t
  modified_base (417)..(423): a, c, t, g, unknown or other
  misc_feature (417)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactactggggtcagggaaccctggtcaccgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnnnnn

SEQ ID NO: 149176 - DNA, 423 bp, Homo sapiens
  misc_feature: GYAE6OF02FXXT6.42.41.D08.1.454.CMB.1.raw
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (418)..(423): a, c, t, g, unknown or other
  misc_feature (418)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgttgactacgtggggtcagggaaccctggtcaccgtctcctcagcctccaccaaggcccatcggtcttccccctggccgccctgctccaggacncacctccgagagcacagccggccctgggctgcctggtcaaggctacttccacatacgtcactgacgcggctggcaaggcgcatagnnnnnn

SEQ ID NO: 149177 - DNA, 435 bp, Homo sapiens
  misc_feature: GYAE6OF02ICKRE.42.41.D08.1.454.CMB.1.raw
  modified_base (221)..(221): a, c, t, g, unknown or other
  misc_feature (221)..(221): n is a, c, g, or t
  modified_base (426)..(435): a, c, t, g, unknown or other
  misc_feature (426)..(435): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtcaccgtctcctcagcctccaccaaggcccatcggtcttccccctggcgcccctgcctccgaggacgccacctccgagagcacacgcggccctgggctgccgtggtcaaggactacttccactatacgtcatgagcgggctggcaacggcgcatagnnnnnnnnnn

SEQ ID NO: 149178 - DNA, 538 bp, Homo sapiens
  misc_feature: GYAE6OF02HT7X4.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgagctctgctactcctcactctccttactcaggacacagggtcgtgggcccagtctgcatccgtgtctgggtctactggacagtcgatcatcatttcctacattggtacctgcagtgattttggggctataacgttatttccttccagacacggggcccccaacgtcctcatttttgagggcagtgaggggccctcaggcctttgtgcgctccgagtctggcgacagggcctccctgacaatctccggactccagctgacgactacggtgattcgtattacgtcgctcatgctgccaagtctggcaatttcggcctcctgactaatctctgactccgagctgaacgacgacgacgattattagttagttcactttaagttgtatttcgtactattcatcgaccgtctacgtcagacccaaggtcctcgtcccccg

SEQ ID NO: 149179 - DNA, 552 bp, Homo sapiens
  misc_feature: GYAE6OF02G3GKG.42.41.D08.1.454.CMB.1.raw
  modified_base (315)..(315): a, c, t, g, unknown or other
  misc_feature (315)..(315): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagttttggggcttataacgttatttccttcccagacgacggggcccccaacgtcctctatttttgagggcagtgaggggccctcaggcctttgngcgctccgagtctggcgacgagggcctccctgacaatctccggactccgaggctgacgacgtacggtgtattcgtattacgtcgtctcatcgctgccaagtctggctaagtttcggcctcctgacatctctgactccagtctagaagacgacgacgtattattagtagttcgcttaagttgattcgtactagttcattcgaccgtccttacgtcacgccaaggtcctcgcccctcgg

SEQ ID NO: 149180 - DNA, 437 bp, Homo sapiens
  misc_feature: GYAE6OF02ICFBS.42.41.D08.1.454.CMB.1.raw
  modified_base (318)..(318): a, c, t, g, unknown or other
  misc_feature (318)..(318): n is a, c, g, or t
  modified_base (428)..(437): a, c, t, g, unknown or other
  misc_feature (428)..(437): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaaccctggtcaccgtctcctcagcctccaccaagggcccatcggtcttccccctggcncccctgcctccaggagcacctccgagagcacaggccggccctgggcctgccctggtcaaggtactacttccacatacgtcactgaggcgggtctggacaaggcgcatagnnnnnnnnnn

SEQ ID NO: 149181 - DNA, 433 bp, Homo sapiens
  misc_feature: GYAE6OF02I7XMD.42.41.D08.1.454.CMB.1.raw
  modified_base (221)..(221): a, c, t, g, unknown or other
  misc_feature (221)..(221): n is a, c, g, or t
  modified_base (421)..(421): a, c, t, g, unknown or other
  misc_feature (421)..(421): n is a, c, g, or t
  modified_base (427)..(433): a, c, t, g, unknown or other
  misc_feature (427)..(433): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactacgtggggtcagggaaccctggtcaccgtctcctcagcctccaccaagggcccatccggtcttccccctggccgcccctgcctccaggacgccacctccgagagccacagccggccctgggcctgccctggtcaaggactacttccacatacgtcactgagcgggctggcaggcncatagnnnnnnn

SEQ ID NO: 149182 - DNA, 432 bp, Homo sapiens
  misc_feature: GYAE6OF02F542T.42.41.D08.1.454.CMB.1.raw
  modified_base (221)..(221): a, c, t, g, unknown or other
  misc_feature (221)..(221): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
  modified_base (422)..(432): a, c, t, g, unknown or other
  misc_feature (422)..(432): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactacgtggggtcagggaaccctggtccaccgtctcctcagcctccaccaagggccccatcggtccttccccctggccgccctgctccgaggacncacctccgagagcacngccggccctgggctgcctggtcaaggctactcacatcgtcacgtgagcgggctggcaaggcncatagnnnnnnnnnnn

SEQ ID NO: 149183 - DNA, 425 bp, Homo sapiens
  misc_feature: GYAE6OF02I8Y7X.42.41.D08.1.454.CMB.1.raw
  modified_base (417)..(425): a, c, t, g, unknown or other
  misc_feature (417)..(425): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactacgtggggtcagggaccctggtcaccgtctcctcagcctccaccaaggcccatcggtcttccccctggcgccctgctccaggagcacctccgagagccacagcggccctgggctgcctggtcaaggctacttccacatacgtcactgagcgggctggcaaggcgcatagnnnnnnnnn

SEQ ID NO: 149184 - DNA, 538 bp, Homo sapiens
  misc_feature: GYAE6OF02FY5OZ.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgtataacgttatttccttcccagacaggggcccccaacgtcctcattttgagggcagtgaggggccctcaggcctttgtgcgctccgagtctggcgacaggggcctccctgacaatctccggactccaggctgacgactacggtgattcgtattacgtcgctcatgctgtcaagtctggcatttgcctccctgacatctctgactccaggctgaagacgacgacgattattagtagttcgactttaagttgtattcgtactattcattcgaccgttcctacgtcacgcccaaggcctcgccccgtcgg

SEQ ID NO: 149185 - DNA, 425 bp, Homo sapiens
  misc_feature: GYAE6OF02GN5PX.42.41.D08.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (421)..(425): a, c, t, g, unknown or other
  misc_feature (421)..(425): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggtttctttgactacgtggggtcagggaaccctggtcaccgtctcctcagcctccaccaaggcccatcggtcttccccctggcgccctgcctccaggancacctccgagacgcacagcggccctgggctgcctggtcaaggactacttccacatacgtcactgacgcgggctggcaaggcgcatagnnnnn

SEQ ID NO: 149186 - DNA, 535 bp, Homo sapiens
  misc_feature: GYAE6OF02IOYAO.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagacaggggcccccaacgtcctcatttttgaggcagtgaggggccctcaggcctttgtgcgctccgagtctggcgacagggcctcctgacaatctccggctccaggctgacgactacggtgattcgtattacgtcgctcatgctgccaagtctggcaagtttggcctcctgacaatctctgactccagctagagacgagacgattattagtagttcgtcttaaagttgattcgtactagttcagtgtaccttccgtacgttcacgcccaaggctcggcccctcgg

SEQ ID NO: 149187 - DNA, 549 bp, Homo sapiens
  misc_feature: GYAE6OF02GT0N9.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttccagacaggggcccccaacgtcctcatttttgagggcagtgaggggccctcaggcctttgtgcgctccgagtctggcgacagggcctccctgacaatctccggactccaggctgacgactacggtgattcgtattacgtcgctcatgctgccaagtctggctaatttcggccttccctgacaatctctcggactccaggctgaacgacgacgacgattagttagtagttcgactttaagttgtatttcgtaactagttcagttcgaccgttcctacgtcacgcccaaggcctcgcccctcgg

SEQ ID NO: 149188 - DNA, 419 bp, Homo sapiens
  misc_feature: GYAE6OF02HN9HC.42.41.D08.1.454.CMB.1.raw
  modified_base (221)..(221): a, c, t, g, unknown or other
  misc_feature (221)..(221): n is a, c, g, or t
  modified_base (416)..(419): a, c, t, g, unknown or other
  misc_feature (416)..(419): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactactggggtcagggaccctggtcaccgtctcctcagcctccaccaagggcccatcggtcttccccctggcgccctgctccaggcgcacctccgagagcacagcggccctgggctgcctggtcaaggctacttccacatacgtcactgagcgggctggcaaggcgcatagnnnn

SEQ ID NO: 149189 - DNA, 423 bp, Homo sapiens
  misc_feature: GYAE6OF02IN0XM.42.41.D08.1.454.CMB.1.raw
  modified_base (221)..(221): a, c, t, g, unknown or other
  misc_feature (221)..(221): n is a, c, g, or t
  modified_base (378)..(378): a, c, t, g, unknown or other
  misc_feature (378)..(378): n is a, c, g, or t
  modified_base (411)..(423): a, c, t, g, unknown or other
  misc_feature (411)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttctttgactacgtggggtcagggaaccctggtcaccgtctcctcagcctccacaagggcccatcggtctcccctggcgccctgctccaggagcacctccgagagcacagtcgccctgggctgcctggtcaaggctactccanatacgtcactgagcggctggcaaggcgcatagnnnnnnnnnnnnn

SEQ ID NO: 149190 - DNA, 434 bp, Homo sapiens
  misc_feature: GYAE6OF02HISD3.42.41.D08.1.454.CMB.1.raw
  modified_base (221)..(221): a, c, t, g, unknown or other
  misc_feature (221)..(221): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
  modified_base (426)..(434): a, c, t, g, unknown or other
  misc_feature (426)..(434): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgactacgtggggtcagggaaccctggtcaccgtctcctcagcctccaccaagggccccatccggtccttccccctggccgcccctgcctccagggacgccacctccgagagcacngccggccctgggctgcctggtcaaggctactccanatacgtcactgagcgggctggacaggcgcatagnnnnnnnnn

SEQ ID NO: 149191 - DNA, 544 bp, Homo sapiens
  misc_feature: GYAE6OF02F675F.42.41.D08.1.454.CMB.1.raw
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgttataacgttatttccttcccagacacggggcccccaacgtcctcatttttgagggcagtgaggggccctcaggcctttgtgcgctccgagtctggcacagggcctccctgacaatctccggactccaggctgacgactacggtgattcgtattacgtcgctnatgctgccagtctgcaatttgcctccctgacaatctctgactccgagtctgaagaccgacgacgtattattagtagttcgattaagttgtattcgtanacttcattcgaccgttcctacgtcacgacccaaggcttaccgcccctaccgg

SEQ ID NO: 149192 - DNA, 552 bp, Homo sapiens
  misc_feature: GYAE6OF02HA2TR.42.41.D08.1.454.CMB.1.raw
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (516)..(517): a, c, t, g, unknown or other
  misc_feature (516)..(517): n is a, c, g, or t
  modified_base (519)..(536): a, c, t, g, unknown or other
  misc_feature (519)..(536): n is a, c, g, or t
  modified_base (539)..(551): a, c, t, g, unknown or other
  misc_feature (539)..(551): n is a, c, g, or t
tcagtgacgtatgtcacgaccggtgctcgatttagtcacgcgagaaagggaaagggcgtggtgtgggtctcagctgttattggtgatgggagtatcacaagatacggggactccgtgaagggccgattcagcatctccagagacaacgccaagaacacgttgtatctggaaatgaacaatctgggagccgaggacacggctgtctatttctgtagtaaaagtcgtgggcggtacaggtttcgtttgactacgtggggtcaggggaaccctggtacaccgtctcctcagccctccaccaagggccccatccggtccttccccctggccgcccctgcctcccgaggacgccacccgtccgagacgccacgacggccggcccctggggccttcggcccgttggggtccgaaacgggtaccttaacctttaccaactacgttaccgtccgacgttcggaagggccggggtacgtcgggacccgaaagggcccgtacgaaacgttaggcancgacngactnncnnnnnnnnnnnnnnnnnntgnnnnnnnnnnnnnc

SEQ ID NO: 149193 - DNA, 423 bp, Homo sapiens
  misc_feature: GYAE6OF02HGPQO.42.41.D08.1.454.CMB.1.raw
  modified_base (225)..(225): a, c, t, g, unknown or other
  misc_feature (225)..(225): n is a, c, g, or t
  modified_base (333)..(333): a, c, t, g, unknown or other
  misc_feature (333)..(333): n is a, c, g, or t
  modified_base (420)..(423): a, c, t, g, unknown or other
  misc_feature (420)..(423): n is a, c, g, or t
tcagtgacgtatgtcacgaccggtgctcgatttagtcacgcgagaaaggggaaagggctggtgtgggtctcagctgttattggtgatgggagtaacacaagatacgggactccgtgaagggccgattcagccatctccagagaccaaccgccaagaacacgttgtatctggaaatgaacaatctgggagccgaggacacggctgtctatttctgtagtaaaaagntcgtgggcgtacaggttcgtttgacttacgtggggtacaggggaaccctggtcaccgtctcctcagcctccaccaaggcccatcgtctcccctgcgccctgctcaggncactcgagagcacagcggccctgggctcgcctggtcaaggactacgttccacatacgtcactgacgcgggctggcaaggcgcatagnnnn

SEQ ID NO: 149194 - DNA, 423 bp, Homo sapiens
  misc_feature: GYAE6OF02HMCRI.42.41.D08.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (418)..(423): a, c, t, g, unknown or other
  misc_feature (418)..(423): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttcngtagtaaaagntctgggcggtacaggttcgttgactacgtggggtcagggaccctggtcaccgtctcctcagcctccaccaagggcccatcggtcttcccctggcgccctgctccaggacgcacctccgagagcacagcggccctgggctgcctggtcaaggactacttccacatacgtcactgagcgggctggcaaggcgcatagnnnnnn

SEQ ID NO: 149195 - DNA, 604 bp, Homo sapiens
  misc_feature: GYAE6OF02JSLVV.42.41.D08.1.454.CMB.1.raw
tcagtgacgtatgtcacgaccggtgctcgatttagtcacgcgagaaagggaaaggggggggtcgacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgtataacgttatttccttccagacaggggcccccaacgtcctctattttgaggcagtgacggggcctcaggcctttgtcgcgcgtccgagtcgtggcgacacgggcctccctgacaatcctccggactccacggctgacgactcggtagattcgtattacgtcgctcatcgtctgaccaagtctcgactagtttcgccctccctgactaatctctacgtactccgagtctacggaacgtaccggaacgtacgtacttaagtttaggttacgttccgtacgtttaagttgacgtttacgtacttagttcctagttacggtacccgttacccttaagtccgtaggtaccctacgggtaccctcggcccccttacgg

SEQ ID NO: 149196 - DNA, 538 bp, Homo sapiens
  misc_feature: GYAE6OF02FNBBR.42.41.D08.1.454.CMB.1.raw
  modified_base (474)..(474): a, c, t, g, unknown or other
  misc_feature (474)..(474): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagacaggggccccccaacgtcctcatttttgagggcagtgaggggccctcaggcctttgtgcgctccgagtctggcgacagggcctccctgacaatctccggactccaggctgacgactacggtgattcgtattacgtcgctcatgctgccaagtctggcaatttggcctccctgacaatctctggactccagctgaagacgacgacgattattagtagttcgnttaagttgatttcgactatttcattgaccgttcctaacgtcacgcccaaggctcgccccttcgg

SEQ ID NO: 149197 - DNA, 500 bp, Homo sapiens
  misc_feature: GYAE6OF02J3G93.42.41.D08.1.454.CMB.1.raw
  modified_base (223)..(223): a, c, t, g, unknown or other
  misc_feature (223)..(223): n is a, c, g, or t
  modified_base (469)..(500): a, c, t, g, unknown or other
  misc_feature (469)..(500): n is a, c, g, or t
tcagtgacgtatgtcacgaccggtgctcgatttagtcacgcgagaaagggaaggggctggtgtgggtctcagctgttattggtgatgggagtaacacaagatacggggactccgtgaagggccgattcagcatctccagagacaacgccaagacacgttgatctggaaatgaacaatcgtgggagccgaggacacggcttgtcttatttcgagtagtaaaagntcgtggggacgttactaggtttcgttgactacgtggggtacacgggtaccctggtccaccgttctcctcacgccctccacgacgggcccatccggtcctccccgtgccgccctgcctccgaggcgccacctccgaagcgcacgagccggccgtggcctcgccgtaggtaccaacggtaccttacttccactacgtaccgtcgaacgtcggacggccggtagtacggcgaacggcgacaagttcgannnnnnnnnnnnnnnnnnnnnnnnnnnnnnnn

SEQ ID NO: 149198 - DNA, 558 bp, Homo sapiens
  misc_feature: GYAE6OF02H5Z1E.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcttataacgttatttccttcccagacacggggcccccaacgtcctcatttttgagggcagtgaggggccctcaggccttttgtgcgctccgagtctggcgacaggcctccctgacaatctccggactccaggctgacgactacggtgattcgtattacgtcgctcatgctgccagtctggctaagtttgcctccctgaccaatcttctggacctccaggctaggaacgaccggaacgacgtatttagttagttagttcgactttaagttgtattcgtactagttcattcgacccttcctacgtcacgccctaaggctccgcccctccgg

SEQ ID NO: 149199 - DNA, 121 bp, Homo sapiens
  misc_feature: GYAE6OF02H53QZ.42.41.D08.1.454.CMB.1.raw
  modified_base (121)..(121): a, c, t, g, unknown or other
  misc_feature (121)..(121): n is a, c, g, or t
tcagtgacgtatgtcacgaccggtgctcgatttagtcacgcgagaaagggaaagggggctggctgtttctgttcccgccctcctcacatacgtcactgagcgggctggcaaggcgcatagn

SEQ ID NO: 149200 - DNA, 425 bp, Homo sapiens
  misc_feature: GYAE6OF02FTXOB.42.41.D08.1.454.CMB.1.raw
  modified_base (221)..(221): a, c, t, g, unknown or other
  misc_feature (221)..(221): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
  modified_base (421)..(425): a, c, t, g, unknown or other
  misc_feature (421)..(425): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcggtacaggttcgtttgactacgtggggtcagggaaccctggtccaccgtctcctcagcctccaccaagggcccatcggtcttccccctggccgccctgctccaggncacctccgagacgcacagcggccctgggctgcctggtcaaggactacttccacatacgtcactgagcgggctggcaaggcncatagnnnnn

SEQ ID NO: 149201 - DNA, 427 bp, Homo sapiens
  misc_feature: GYAE6OF02HVTQI.42.41.D08.1.454.CMB.1.raw
  modified_base (418)..(427): a, c, t, g, unknown or other
  misc_feature (418)..(427): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggttcgtttgactactggggtcagggaccctggtcaccgtctcctcagcctccaccaaggcccatcggtctccccctgcgccctgctccagagcacctccgagagcacagccggccctgggctcgcctggtccaaggcctacttccacataccgtcactgagcgggctgggcaaggcgcatagnnnnnnnnnn

SEQ ID NO: 149202 - DNA, 624 bp, Homo sapiens
  misc_feature: GYAE6OF02IYW96.42.41.D08.1.454.CMB.1.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
tcagtgacgtatgtcacgaccggtgctcgatttagtcacgcgagaaagggaaaggggggggtcgacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagtacaggggcccccaagtcctcattttgaggcagtgagggcccncaggcttgtgcgctaccgngtctggcgacacggcctccctgacatcctccggactccaggtctacgacgactacggtgacttcgtattacgtcgcttcatgcttanccgtaagtcctagcgtaagtttcggtccctccgttagaacctaacttccgttacctcgggtacctccgtaaggtcgtaggaacgaccgtaacgtcgtaagtttaacttagttaacgtttcgacttttaaggtctacgttaccgttataacgtttctaagttccggtaacccgttccgtaaccgttctacggaccctaacgggtcccttaccggcccccttcgg

SEQ ID NO: 149203 - DNA, 454 bp, Homo sapiens
  misc_feature: GYAE6OF02IXPM5.42.41.D08.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (443)..(454): a, c, t, g, unknown or other
  misc_feature (443)..(454): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttcngtagtaaaagntctgggcgtacaggttcgttgactacgtggggtcagggaccctggtcaccgtctcctcagcctccaccaacgggccccagtccggtccttccccctggccgcccctgcctccgaggacgccaccctccggagacgcacgagccggccctgggctcgcctggtccaaggacctacttccactactacgtcactggagcgggctcggacaagggcgcagtagnnnnnnnnnnnn

SEQ ID NO: 149204 - DNA, 532 bp, Homo sapiens
  misc_feature: GYAE6OF02HCC8D.42.41.D08.1.454.CMB.1.raw
tcagtgacgtatgtcacgaccggtgctcgatttagtcacgcgagaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttccagacacggggcccccaagtcctcatttttgaggcagtgaggggccctcaggcctttgtgcgctccgagtctggcgacagggcctcctgacaatctccggactccaggctgacgactacggtgattcgtattacgtcgctcatgctgccaagtctggcaatttggcctcctgacaatctctgactccagtctgaagcgacgacgattattagtattcgcttaagttgtattcgtactagttcattgaaccgttcctacgtcagcccaaggcctcgcccccttcgg

SEQ ID NO: 149205 - DNA, 425 bp, Homo sapiens
  misc_feature: GYAE6OF02FXFJT.42.41.D08.1.454.CMB.1.raw
  modified_base (419)..(425): a, c, t, g, unknown or other
  misc_feature (419)..(425): n is a, c, g, or t
tcagtgacgtatgtcacgaccggtgctcgatttagtcacgcgagaaagggaaggggctggtgtggtctcagctgttattggtgatgggagtaacacaagatacggggactccgtgaagggccgattcagcatctccagagacaacgccaagaacacgttgtatctggaaatgaacaatctgggagccgaggacacggctgtctattctgtgtaaaagatctgggcggtacaggttcgtttgactactggggtcagggaacccctggtcaccgtctcctcagccctccaccaagggccccatcggtcttcccccctgcgccctgctccaggagcacctccgagagcacagcggccctggggctgcctggtcaaggactacttccacatacgtcactgagcgggctggcaaggcgcatagnnnnnnn

SEQ ID NO: 149206 - DNA, 426 bp, Homo sapiens
  misc_feature: GYAE6OF02GVKJ7.42.41.D08.1.454.CMB.1.raw
  modified_base (383)..(383): a, c, t, g, unknown or other
  misc_feature (383)..(383): n is a, c, g, or t
  modified_base (418)..(426): a, c, t, g, unknown or other
  misc_feature (418)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtccatttctgtagtaaaagatctgggcgtacaggttcgttgactacgtggggtcagggaaccctggtcaccgtctcctcagcctccaccaagggcccatcggtcttccccctggcgccctgctccaggacgcacctccgagagcacagcggccctgggctgcctggcaaggctacttccanatacgtcactgagcgggctgggcaaggcgcatagnnnnnnnnn

SEQ ID NO: 149207 - DNA, 459 bp, Homo sapiens
  misc_feature: GYAE6OF02GYILR.42.41.D08.1.454.CMB.1.raw
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (448)..(459): a, c, t, g, unknown or other
  misc_feature (448)..(459): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagntctgggcgtacaggttcgtttgacttacgtggggtcagggaaccctggtcaccgtctcctcagcctccaccaagggcccatcgtcttccccctgccgccctgcctccaggngccaccgtccgagagccacgagccggccctggggctcggcccgtgggtacaacgggtacttaccttccactacttaccgtcacttggacgcgggcgtggacgaacgggcgcatagnnnnnnnnnnnn

SEQ ID NO: 149208 - DNA, 541 bp, Homo sapiens
  misc_feature: GYAE6OF02GLEAR.42.41.D08.1.454.CMB.1.raw
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (504)..(504): a, c, t, g, unknown or other
  misc_feature (504)..(504): n is a, c, g, or t
  modified_base (508)..(541): a, c, t, g, unknown or other
  misc_feature (508)..(541): n is a, c, g, or t
tcagtgacgtatgtcacgaccggtgctcgatttagtcacgcgagaaagggaaaggggctggtgtgagtctcagctgttattggtgatgggagtaacacaagatacggggactccgtgaagggccgattcagcatctccagagacaacgccaaagaacacgttgtatctggaaatgaacaatctgggagccgaggacacggctgtctatttctgtagtaaaaagntcgtgggcggtacaggtttcgttgactacgtggggtcaggggaaccctggtcacccgtctccctnacgcctccaaccgaacgggcccagtccggtcccttcccccgnggcccgccctgcctccgagggacgcccacccgtcccgaagacgaccacgacggcccggtccccgtggggctcggtcccgtagggtacaaacgggtcctaccgtaccacctaacgtaccgtcgtactacggacgggtcgggtcggtcggaccggaaggtccggactaacgtagngcannnnnnnnnnnnnnnnnnnnnnnnnnnnnnnnnn

SEQ ID NO: 149209 - DNA, 557 bp, Homo sapiens
  misc_feature: GYAE6OF02GK821.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgagttttggggcttataacgttatttccttcccagaccacggggcccccaacgtcctcatttttgaggcagtgaggggccctcaggcctttgtgcgctccgagtctggcgacagggcctccctgacaatcctccggactccaggctgacgactacggtgattcgtattacgtcgctcatgctgccaagtctggctaagtttcgcccttcctgacaatctcgtcgacctccgagctagaacgacgacgacgtattagttacgttagttcgtactttaagttgtatttcgtactattcattcgaccttcctacgtcacgccaaggtcctccgcccctcgg

SEQ ID NO: 149210 - DNA, 549 bp, Homo sapiens
  misc_feature: GYAE6OF02HO93A.42.41.D08.1.454.CMB.1.raw
  modified_base (213)..(213): a, c, t, g, unknown or other
  misc_feature (213)..(213): n is a, c, g, or t
  modified_base (512)..(549): a, c, t, g, unknown or other
  misc_feature (512)..(549): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaaagaacacgttgtatctaggaaatgaacaatctgggagccgaggacacggctgtctatttcngtagtaaaagtcgtgggcggtacaggtttcgttgacttacgtggggtcagggaccctggtcaccgtctcctcacgccctccaaccaacgggccccattccggttccttcccccgtggcccgcccctcgcctcccgagggacgccaccgtccggagacgccacgacggcccggcccgtggggctcggccgtcggtacgaaacggtaccttaccttaccaactacgttaaccgtcctaacgtcggaacgggtccggggctcgggaccgtaaagggggcccgaccgtaagtaaggcagcgannnnnnnnnnnnnnnnnnnnnnnnnnnnnnnnnnnnnn

SEQ ID NO: 149211 - DNA, 678 bp, Homo sapiens
  misc_feature: GYAE6OF02GZ7NR.42.41.D08.1.454.CMB.1.raw
  modified_base (229)..(229): a, c, t, g, unknown or other
  misc_feature (229)..(229): n is a, c, g, or t
  modified_base (588)..(588): a, c, t, g, unknown or other
  misc_feature (588)..(588): n is a, c, g, or t
  modified_base (616)..(616): a, c, t, g, unknown or other
  misc_feature (616)..(616): n is a, c, g, or t
tcagtgacgtatgtcacgaccggtgctcgatttagtcacgcgagaaagggaaaggggtcgtggtgtgggtctcagctgttagttggtgatgggagtaacacaagatacggggactacgtgaaggccgattcagcatctccagagacaacgccaagaacacgttgtatctggaaatgaacgaatcgtcgggagccgaggacacggctgtctactttcctgtagtaaaagntcgtcgggcggtacaggttcgtttgactacgtgggtcagggaaccctggtcaccgtctcctcagcctccaccgaaggcccagtccggtccttcccccgtggccgtcccgtcgcctccgacggacgccacctccggacgacgccacgacggccggtaccctggggacctacggacccgttgggtacccgaaacgggtaccgtttaaccgttcccaacgtaacgttaacccggttacctaaccgttcggaaccgggtccggggtaccgttacggggaacccgtaaacggggtcccgtaccgtaacgttaacgggtcctacgttcgacctcgtgtacgtcgtacgcgtcgtacgtagtacgngacgtacgtcgtacgtacgtcgtcgtcncgtagtacgtacgacgacgtcgtacgtagtagtcgtgtcgtcgtcgcgacgtacgtacgtcg

SEQ ID NO: 149212 - DNA, 453 bp, Homo sapiens
  misc_feature: GYAE6OF02GJHNM.42.41.D08.1.454.CMB.1.raw
  modified_base (224)..(224): a, c, t, g, unknown or other
  misc_feature (224)..(224): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (434)..(434): a, c, t, g, unknown or other
  misc_feature (434)..(434): n is a, c, g, or t
  modified_base (440)..(453): a, c, t, g, unknown or other
  misc_feature (440)..(453): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaaagntctgggcggtacaggttcgtttgactacgtggggtcagggaaccctgtcaccgtctcctcagcctccaccaaggcccatcggtccttcccccnggccnccctgctccgaggacgcacctccgagacgccacaggccggcccgtgggctcggccctaggtaccaaaggacctacttccacataacgtcactgagcgggctggacaaggcgnagtagnnnnnnnnnnnnnn

SEQ ID NO: 149213 - DNA, 587 bp, Homo sapiens
  misc_feature: GYAE6OF02J2U4V.42.41.D08.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccattcagcatctcagagacaacgccaagaacacgttgatctggaaatgaacaatctgggagccgaggacacggctgtctatttcngtagtaaaagntctgggcgtacaggtttcgttgactacgtgggtccagggtaccctggtcacgtctcctcagcctcaccaagggcccagtccggtcttcccccctggccgtcccctggccttcccgaggcgcacctccgagacgcacgacggccggccctggggcctggaccgtgggtaccaagggtcctaacttccgactagtaaccgttcaaccgttgaacgccgggtccgtgggaccaaagggtcgacgtaacgtacggacncgacgnagtcgngacgagcgacgcncgagtacgtcgcgcncgactcgcgacgcgacgacacgacgtcgtcgtactacgtacgtacgacgtacgcacgtacgacacgtacgtacg

SEQ ID NO: 149214 - DNA, 478 bp, Homo sapiens
  misc_feature: GYAE6OF02IGS5A.42.41.D08.1.454.CMB.1.raw
  modified_base (223)..(223): a, c, t, g, unknown or other
  misc_feature (223)..(223): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (462)..(478): a, c, t, g, unknown or other
  misc_feature (462)..(478): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctattttctgtagtaaaagntctgggcggtacaggtttcgttgactacgtggggtcagggaccctggtcaccgtctcctcagcctccaccaacgggccccagtccggtccttccccccgtggccgcccctgtcctccgaggacgccaccgtccgagacgaccacgaggccggcccgtgggcctcgccgtggtacaaggtacctacttccaactatacgtacactggacggcgggtncggacgaacggcganaatgncannnnnnnnnnnnnnnnn

SEQ ID NO: 149215 - DNA, 436 bp, Homo sapiens
  misc_feature: GYAE6OF02FG116.42.41.D08.1.454.CMB.1.raw
  modified_base (428)..(436): a, c, t, g, unknown or other
  misc_feature (428)..(436): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcggtacaggtttcgtttgactacgtggggtcagggaaccctggtcaccgtctcctcagcctccaccaagggccccatcggtcttcccccctggccgcccctgcctccaggacgccacctccgagacgcacagcggccctgggctgcctggtcaaggactacttccacatacgtcactgagcgggctggcaaggcgcatagnnnnnnnnn

SEQ ID NO: 149216 - DNA, 543 bp, Homo sapiens
  misc_feature: GYAE6OF02FHW66.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtattttggggctataacgttatttccttccagacacggggcccccaacgtcctcattttgaggcagtgaggggccctgaggcctttgtgcgctccgagtctggcgacagggcctcccgtgacaatctccggactccaggctgacgactacggtgattcgtattacgtcgctcatgctgccaagtctggctaatttggcctcctgacaatctcgtgactccaggctagaagaccgacgacgattagttagtagttcgacttaagttgtatttcgtacatttcattcgaccgttcctagtcacgccctaggcctcgccccctcgg

SEQ ID NO: 149217 - DNA, 706 bp, Homo sapiens
  misc_feature: GYAE6OF02FEXGJ.42.41.D08.1.454.CMB.1.raw
tcagtgacgtatgtcacgaccggtgctcgatttagtcacgcgagaaagggaaggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttccacagttcggtacctgcagttcggtagttttggggacttattaacgtttacttccttccgagtaccgaccggggtccccctaacggttccttactagtttttacggacgggtccgtaggtcggtacggggtccccttcgaacgggttccttttggtcgccggtacgtccggtagtcgttacggacgtaccgacggggtccctacccgtagtaacgtaacttccgtacccggtactccgtacggcgttacggaccgtacgtacgggtatacgtttacgtagttaccgtcgtcttacgagtcgctacgaccgtaagtcgtacgacttaacggttccggcccttacgtagacctacttccgtcgtacgaccttccggagtacgacgaacggaccgagtacttattaggttagttcgtactacgttagtcttacgttacacgtcttcgacgtccgttaacccttcgtaaccgtcgaccgtaccgtacggcccgttacccgccccgttacgg

SEQ ID NO: 149218 - DNA, 567 bp, Homo sapiens
  misc_feature: GYAE6OF02F3SMF.42.41.D08.1.454.CMB.1.raw
  modified_base (436)..(436): a, c, t, g, unknown or other
  misc_feature (436)..(436): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggctataacgttatttccttcccagacacggggcccccaacgtcctcatttttgagggcagtgaggggcccctcaggcctttgtgcgctccgagtctggcgacgagggcctccctgacaatctccggactccaggctgacgactacggtgattcgtattacgtcgctcatgctgccaagtctggctagttcgcctccctgacactctcnggctccgagctagagacgaacgacgattagttagttagttcgtctttaagttgtactttacgtactagttctattcgtacccgttacgtacgttcgacgtaccccgaaggtcctccggtccccccttacgg

SEQ ID NO: 149219 - DNA, 556 bp, Homo sapiens
  misc_feature: GYAE6OF02GMSZZ.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttccacattggtacctgcagtgattttggggctataacgttattccttccagacagggggcccccaagtcctcatttttgagggcagtgaggggcccctcaggcctttgtcgcgctccgagtctggcgacagggcctcctgacaatctccggactccaggctgacgactacggtgattcgtattacgtcgctcatgctgccaagtctggctaagtttggcctcctgaccaatctctggactccgagcctagaacgacgacggactattatagttgttcgtcttaagttgtattcgtactagttccattacgacccgttcctacgtccacggccccgaaggcctaccggcccccttccgg

SEQ ID NO: 149220 - DNA, 596 bp, Homo sapiens
  misc_feature: GYAE6OF02GYWLI.42.41.D08.1.454.CMB.1.raw
  modified_base (418)..(418): a, c, t, g, unknown or other
  misc_feature (418)..(418): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcttataacgttatttccttccagacacggggcccccaagtcctcatttttgaggcagtgaggggccctcaggtcctttgtcgcgctccgagtctggcgacgagggccctcccgtgaccaattcctccggactccgaggctgaccgactacggtgattcgtacttacgtcgctcatgctcgccaagttcngctagtttcggcctccgtgacctattcgtctcggacctcgagtctgaacgacgacgacgtattagttagtacgtttacgtacgtttaagttgtacgttacgtactacttcggaacttcggtacccgttaccttacggtaccacggtacccgtaaggtcccttaccgtcccccttacgg

SEQ ID NO: 149221 - DNA, 618 bp, Homo sapiens
  misc_feature: GYAE6OF02IB42A.42.41.D08.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (501)..(502): a, c, t, g, unknown or other
  misc_feature (501)..(502): n is a, c, g, or t
  modified_base (516)..(516): a, c, t, g, unknown or other
  misc_feature (516)..(516): n is a, c, g, or t
tcagtgacgtatgtcacgaccggtgctcgattttagtcacgcgagaaagggaaaggggctggtgtgggtctcagctgttattggtgatgggagtaacacaagatacggggactcgtgaagggccgattcagcatctcagagacaacgccaagaacacgttgtatctggaaatgaacaatctgggagccgaggacacggctgtctattttcngtagtaaagatctgggcgtactaggttcgtttgacttacgtggggtcagggaccctggtcaccgtctcctcagtcctaccaccgaagggccccagtcggtccttcccccgtggcncccctgcctccagggacncacctcgagagcaacgacgccggccctgggcctacggccttgggactaaacggacctttaacccttccaacgtcttaaccgtcaaccttggaccgggtccgggtcgtacgggtaccgaacggggtccgacgtaagtaggnacgtacgngacgatagnntagactagacgtanacgtacctagagacttagtacgacgtacgtacgtacgtagtacgacgtacggtacgacgtaggtacgtacgtacgacgtacgtagtacgtacgtactgtacg

SEQ ID NO: 149222 - DNA, 597 bp, Homo sapiens
  misc_feature: GYAE6OF02HY4VE.42.41.D08.1.454.CMB.1.raw
  modified_base (303)..(303): a, c, t, g, unknown or other
  misc_feature (303)..(303): n is a, c, g, or t
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
  modified_base (472)..(472): a, c, t, g, unknown or other
  misc_feature (472)..(472): n is a, c, g, or t
tcagtgacgtatgtcacgaccggtgctcgatttagtcacgcgagaaaggggaaaggggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttgggggctataacgttatttccttccagtacaggggccccccaaggtcctctattttgaggcagtgaggggtccctnaggtcctttgtgcgctccgagtctggcgacagggcctccctgaccaatccncggactccagctgacgactacggtnacttcgtaattaccgtcgctctatcgctgaccaagtctggctaagtttcggccctccctgaacctaaactcttctcggacctccagggcctanaacgaacgaacggacgactttagttagtaacgttcgtacgtttaaagttgtacttcgtaactagttcagttacgaaccgttccctaacgtccacgtacccgaaggtctacccggcccccgtacgg

SEQ ID NO: 149223 - DNA, 426 bp, Homo sapiens
  misc_feature: GYAE6OF02GARJC.42.41.D08.1.454.CMB.1.raw
  modified_base (222)..(222): a, c, t, g, unknown or other
  misc_feature (222)..(222): n is a, c, g, or t
  modified_base (386)..(386): a, c, t, g, unknown or other
  misc_feature (386)..(386): n is a, c, g, or t
  modified_base (420)..(426): a, c, t, g, unknown or other
  misc_feature (420)..(426): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaaagntctgggcggtacaggttcgtttgactactggggtcagggaaccctggtcaccgtctcctcagcctccaccaagggccccatcggtcttccccctggccgccctgctccaggacgcacctccgagagcacagcggccctgggctgcctggtcaaggctactccanatacgtcactgagcgggctggcaaggcgcatagnnnnnnn

SEQ ID NO: 149224 - DNA, 545 bp, Homo sapiens
  misc_feature: GYAE6OF02FHRI9.42.41.D08.1.454.CMB.1.raw
  modified_base (435)..(435): a, c, t, g, unknown or other
  misc_feature (435)..(435): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgattttggggcgtataacgttatttccttccagacaggggcccccaagtcctcatttttgagggcagtgaggggcccctcaggcctttgtgcgctccgagtctggcgacagggccctccctgacaatctccggactccgagctgaccgactacggtgattcgtattacgtcgctcatgctgcctaagtctgcaagtttcggcctcctgacatctcngactcagctgaagacgacgacgatttagttacgttagttcgtacttagttgatttcgactatttcattcggaccctcgtaccgtcacgacccaaggctcgcccccttcgg

SEQ ID NO: 149225 - DNA, 581 bp, Homo sapiens
  misc_feature: GYAE6OF02GTYM3.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtattttggggcttataacgttatttccttccagacgacggggcccccaacgtcctctattttgaggcagtgaggggccctcaggcctttgtgcgctccgagtctggcgacgacgggcctcccgtgacaacttccgtcccggtactcccgaggcctgaccgtacgtacggtgtacgttcgttattacgtcgtctctatcgctcgaccaagtctggactaagtttcggcctccgtagactaactcttcgtcggactccgagtctgaacgacgacgacgtattagtagttgttacgtcttaagtgtacttcgtactagttcattcgtaccgtctacgtcacgacccgaggcctccgccccgtcg

SEQ ID NO: 149226 - DNA, 434 bp, Homo sapiens
  misc_feature: GYAE6OF02HJ1P9.42.41.D08.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (423)..(423): a, c, t, g, unknown or other
  misc_feature (423)..(423): n is a, c, g, or t
  modified_base (429)..(434): a, c, t, g, unknown or other
  misc_feature (429)..(434): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctcagagacaacgccaagaacacgttgtatctggaaatgaacaatctggganccgagacacggctgtctatttcngtagtaaaaagntctgggcgtacaggtttcgtttgactacgtggggtacagggaaccctggtacaccgtctcctcacgcctccacaacgggcccatcggtcttcccccgtgccgccctgctccaggacgcacctccgagagcacacgccgccctgggcctgccgtggtcaaggacttacgttccacatacgtcactgagcgggctggcaaggcncatagnnnnnn

SEQ ID NO: 149227 - DNA, 453 bp, Homo sapiens
  misc_feature: GYAE6OF02F14L3.42.41.D08.1.454.CMB.1.raw
  modified_base (223)..(223): a, c, t, g, unknown or other
  misc_feature (223)..(223): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (443)..(453): a, c, t, g, unknown or other
  misc_feature (443)..(453): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaaacaatctgggagccgaggacacggctgtctatttctgtagtaaaagntcgtgggcggtacaggtttcgtttgactacgtggggtcagggaaccctggtcaccgtctcctcacgcctccaccaagggcccagtccggtccttccccccgtggccgtccctcgcctccgaggacgccacctccggagacgcacgagccggccctgggcctgccctggtcaacgctacttccaacatacgtcactgacgcggcnggcacggcgcatgngnnnnnnnnnnn

SEQ ID NO: 149228 - DNA, 467 bp, Homo sapiens
  misc_feature: GYAE6OF02H43F2.42.41.D08.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (449)..(449): a, c, t, g, unknown or other
  misc_feature (449)..(449): n is a, c, g, or t
  modified_base (451)..(467): a, c, t, g, unknown or other
  misc_feature (451)..(467): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctcagagacaacgccaagaacacgttgtatctggaaatgaacaatctggganccgagacacggctgtctatttcngtagtaaaagntcgtgggcgttacagggttcgtttgactacgtggggtcagggaccctggtcaccgtctcctcagcctcccacgaacggccccagtccggtccttccccctggcncccctgcctccgaggacgccacctccgganacgcacgagccggcctggtcgcgcgtcgtacgacgacgttactccgacctatacgtcactaggaggcggtcgtcggtacgacggacgcacgtagngnnnnnnnnnnnnnnnnn

SEQ ID NO: 149229 - DNA, 563 bp, Homo sapiens
  misc_feature: GYAE6OF02FZK7N.42.41.D08.1.454.CMB.1.raw
  modified_base (222)..(222): a, c, t, g, unknown or other
  misc_feature (222)..(222): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (529)..(563): a, c, t, g, unknown or other
  misc_feature (529)..(563): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcgtacaggtttcgtttgactacgtggggtcacgggaaccctggtcaccgtctcctcagcctccaccaagggccccatcggtccttcccccctggccgccctgcctcccaggacgccaccctccgagacgccaacgacggccggccccgtggggcctcggcccttggggtaccaaacggggacctttaaccctttcccgaacctacgtttaaccggtccctaaccgttggaaccgggtcccgggggtccgttacggggacccgaaaggggcccggaccgaaagttacgggctagngctngnnnnnnnnnnnnnnnnnnnnnnnnnnnnnnnnnnn

SEQ ID NO: 149230 - DNA, 565 bp, Homo sapiens
  misc_feature: GYAE6OF02FL016.42.41.D08.1.454.CMB.1.raw
  modified_base (303)..(303): a, c, t, g, unknown or other
  misc_feature (303)..(303): n is a, c, g, or t
tcagtgacgtatgtcacgaccggtgctcgatttagtcacgcgagaaagggaaaggggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtatttggggctatacgttattccttccagacacgggccccaacgtcctcattttgaggcagtgagggccctgaggcctttgngcgctccgagtctggcgacacgggcctcctgacaatcgtccggactccgaggtcctgacgacttacggtgtattcgtattacggtcgctcatgctgccagtctagctaattcgcctacctgaccatctctgactccgagcctagaacgacgacgacgtattattacgtagttcgttacttagttcgtatttccgattacttactagtacgtacccgttccgtacgtcgtacgacccgtaacggccgtcctacccccggtccg

SEQ ID NO: 149231 - DNA, 532 bp, Homo sapiens
  misc_feature: GYAE6OF02FSVGT.42.41.D08.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (374)..(374): a, c, t, g, unknown or other
  misc_feature (374)..(374): n is a, c, g, or t
  modified_base (491)..(496): a, c, t, g, unknown or other
  misc_feature (491)..(496): n is a, c, g, or t
  modified_base (498)..(502): a, c, t, g, unknown or other
  misc_feature (498)..(502): n is a, c, g, or t
  modified_base (504)..(509): a, c, t, g, unknown or other
  misc_feature (504)..(509): n is a, c, g, or t
  modified_base (511)..(532): a, c, t, g, unknown or other
  misc_feature (511)..(532): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctggganccgaggacacggctgtctatttctgtagtaaaaagntctggggcgttacaggtttcgtttgactacgtgggtcagggaccctggtcaccgtctccncagcctccacgaacggcccatccggtcttcccccgtggccgccctgcctccgaggacgcaccctcgacgacgcacgacggccggtcccgngggcctgcccgtaggtcgaaacggtacctacttcccgaactacttacccggtaccaccgtttacggaacgccgggggtacttcggggaccaaacggggtcgccgtaagtaccgagcnnnnnncnnnnngnnnnnncnnnnnnnnnnnnnnnnnnnnnn

SEQ ID NO: 149232 - DNA, 631 bp, Homo sapiens
  misc_feature: GYAE6OF02FLOEN.42.41.D08.1.454.CMB.1.raw
  modified_base (326)..(326): a, c, t, g, unknown or other
  misc_feature (326)..(326): n is a, c, g, or t
  modified_base (407)..(407): a, c, t, g, unknown or other
  misc_feature (407)..(407): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttccctacatttggtacctgctagtgtagttttggggacgttattaacgtttactttccttacccagaccgaccggggacccccaacgtcctctattttgaggctagtgacgggcctgagtcctttgngcgctccgagtcgtggcgacgacgggtcctcccgtagacgaactccgtccggactccgaggtcctagaccgacgtacggtntacgttcgttacttacgtcgtctcatcgctcgtactaacgtcgtgcttaagttcgtaccctcctcgactactctcgtcgctccgagtcgtagacgacgagtacgtaagttacttagttacgttcgttacgttaagttgtacgtttcgtactacttcgattccgtaccgttaccgtacgtacccacggtaccccgtaacggtcccgtaccgtcccccgttaccgg

SEQ ID NO: 149233 - DNA, 879 bp, Homo sapiens
  misc_feature: GYAE6OF02GBB0E.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttccactattcggtacctgctaggttggttagtttcgggacttaacttacgtttactttccctaccgaaggtaccggaccccggggaccccctaacggttcccttacgtttagttttacggacggtacgtacgggtacgggtaccgggtcccctacggtacggttccgtttcggtcggtaccgtccggtaccggtacgttaccggtcgggaccgtaccggaccggtccccgttcccgtacgtaaacctaaccgttcccgtacccggtacctaccgacggtcgacggtaaccgtacggtacggttacgttagtttacgttaacgttacgtccgtccgtacgtacgtcgtaccgtacgtaccgtaacgttcgtacgtaacgtttacgtttcccgtacccttacccgtaagtaaccctaacgttccgttacgtaccggtacccgtacccgtaggtaaccgtaacggaaccgtaaccggtaaccggttaacgtttaacgttttaaacggtttaacggtttacccgtttacggtttaacgttaaacggtttacgtttacccgtttaacgttaccgttaacgtttccggtaaccggttacccgggttaaccccgtaccgtttaaccgacccgtaaccccgggttaaccgacccggtttcccggtaccccgttacccccggttacccg

SEQ ID NO: 149234 - DNA, 742 bp, Homo sapiens
  misc_feature: GYAE6OF02JSCUG.42.41.D08.1.454.CMB.1.raw
tcagtgacgtatgtcacgaccggtgctcgatttagtcacgcgagaaagggaaagggggggggtcgacaagaggcagcgctctcgggacgtctccaccatggcctgggctctgctactcctcactctccttactcaggacacagggtcgtggcccagtctgcatccgtgtctgggtctactggacagtcgatcatctatttcctactattcggtacctgcagtgtagtttggggctattaacgttatttcccttacccagtaccgacggggtcccccaacgtccttctacttttggacggtaccagttacggcggggcccctcgacggtccgtttggtcgtccgcgtccggtgtcgtcggaccgacgacgggtcctccgtcgaacactccgtaccggacctactcggacctacggaaccgtacgtcggtagtacgttcggttacttacgtccgtctactacgtgtcgtaccgaccgtaacggttcgtacggtccttaaacggtttccggtcccttaccgtacgtaaccttaacgtcgtttacgtcccggtacttaccggcgtctaacggtaacgaaccgtacgtaacgtactttacggttaacgttgttacccgttaagttacgtttacggtactttaccggtaatttccgtaacgtttacgtaccggttaacccgtttccccgtaacttacggacccggttaacccgttaaccgggtccctccccgggttacccttacccgg

SEQ ID NO: 149235 - DNA, 687 bp, Homo sapiens
  misc_feature: GYAE6OF02GBBPZ.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttcctactattggtacctgcagtgtagtttgggcgtattaacgttactttcctccagacgacggggcccccaacgtcctctatttgaggcagtcggagggccctgacggtccttgtcgccgtcctccggagtcgtcggaccgacgtacgggcccttccgtacgacaacgtcgtcccggactccgaggtctacggacgtacgtacggtatacgttcgtagttccgtcgtcctactagtcgcctcgtaccgtaagttcgtagtacctaaggtttccggccctcccgtagtaacctaacttccgtaacgtcgtacctccgcgtactacgggtaacgaccggtaacgtacgttaacttaagttaacggtttacgttaacgttacgtttaacgttgttactttacgtactacgttactaccgttacgtaaccctttccgttaacgtacccgtaccggttacccgaaccgttcccgtacccgtcccccgtaccgg

SEQ ID NO: 149236 - DNA, 475 bp, Homo sapiens
  misc_feature: GYAE6OF02GTJMO.42.41.D08.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (462)..(475): a, c, t, g, unknown or other
  misc_feature (462)..(475): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggntgtcttatttctgtagtaaaagntcgtgggcgtacnggtttcgtttgactacgtggggtcacgggtaaccctggtccaccgtctcctcagccctccaccaagggcccagtcggtccttccccctggccgcccctgcctccgacggacgccaccgtccgagacgccacgaggccggcccgtcgggctcggccgtacggtcaaaggaccttacgttccactataccgtcaacgtggacggcgggctggcgaaggcgcagtacgnnnnnnnnnnnnnn

SEQ ID NO: 149237 - DNA, 693 bp, Homo sapiens
  misc_feature: GYAE6OF02GSK8V.42.41.D08.1.454.CMB.1.raw
tcagtgacgtatgtcacgaccggtgctcgatttagtcacgcgagaaagggaaagggggggggtcacaagaggcagcgctctcgggacgtcctccaccatggcctgggctctgctactcctcactctccttactcaggacacagggtcgtgggcccagtctgcagtccgtgtcgtgggtctacgtggacagtcgatcatctatttccctactattggtacctgcagtgtagttttggggacttattaacgtttactttccttacccagaccgaccggggccccctaacgtcctctattttggaggctaggtggacggggtcctcgacggtcctttggtcgccgtccgtccggtagtcgtcgggcgtaacggtccgggtccctcccgtgaacctaacgttcccgtccggtacctccgacggcgtacgaaccgtaccgtacggtgtacgtttcgtaacttacgtccgtactctagtcggctcgtacctaacggttcgtaggtacttaacggtttccggccctttacccgtaggtaaccaacttccggttcgtacggtacctcgagtctagaacgtacgaacgtagttattagtagttacgttaccgttagtttaagtgtacttacgtactactctacgtaccgtacccgtccgttacgaccgtaccggtacccgacgtccgtccgtccccgtacgg

SEQ ID NO: 149238 - DNA, 553 bp, Homo sapiens
  misc_feature: GYAE6OF02I1BDG.42.41.D08.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (329)..(329): a, c, t, g, unknown or other
  misc_feature (329)..(329): n is a, c, g, or t
  modified_base (486)..(486): a, c, t, g, unknown or other
  misc_feature (486)..(486): n is a, c, g, or t
  modified_base (496)..(497): a, c, t, g, unknown or other
  misc_feature (496)..(497): n is a, c, g, or t
  modified_base (499)..(500): a, c, t, g, unknown or other
  misc_feature (499)..(500): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (524)..(525): a, c, t, g, unknown or other
  misc_feature (524)..(525): n is a, c, g, or t
  modified_base (527)..(528): a, c, t, g, unknown or other
  misc_feature (527)..(528): n is a, c, g, or t
  modified_base (530)..(531): a, c, t, g, unknown or other
  misc_feature (530)..(531): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(548): a, c, t, g, unknown or other
  misc_feature (548)..(548): n is a, c, g, or t
  modified_base (551)..(553): a, c, t, g, unknown or other
  misc_feature (551)..(553): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttcngtagtaaaantcgtgggcggtactaggtttcgtttgacttacgtgggggtacagggaaccctggtaccaccgtctcctcacgcctccaaccaacgggcccagtccgtccttccccgnggccgccctgccgtccgacggacgccaccgtccgagacgcacgacgccggtcctgggctcgaccgttgggtaccaacggacttaccgttaccaactactaaccgttacacgttcggacggtccgggcgtcggacgaaacgggcgtaacgactaaggntacgagtcannanncangacagacnancncanacnacnnannanncgnnanacangnannanagnnn

SEQ ID NO: 149239 - DNA, 624 bp, Homo sapiens
  misc_feature: GYAE6OF02HRUEL.42.41.D08.1.454.CMB.1.raw
  modified_base (221)..(221): a, c, t, g, unknown or other
  misc_feature (221)..(221): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagtgacgtatgtcacgaccggtgctcgatttagtcacgcgagaaagggaaaggggctgggtgtgggtctcagctgttattggtgatgggagtaacacaagatacggggactccgtgaagggccgattcagcatctccagagacaacgccaagaacacgttgtatctggaaatgaacatctggagccgagacacggctgtctatttctggtagtaaaagntcgtgggacgtacaggtttcgttgactacgtgggtcacgggtaaccctggtccaccgttccttccctgacgccctaccacgaacggcccagttccggtcccttaccccgnggcccnccctggcctaccggaggcnccgaccgtccgacgacgctacgacggtccgcccgtggcgtacgccgtaggtacaacggtcctaccgttccgatacgttaccgatacgtcggacgggcggtccgtggacgacggtcgcgtaagcgtcaggtcngtacgngtnacagtccgataccgngtacgtacgtacgtctaccgtgtaccgtcgttacgacgtagttcgaacgcgttaaggtccgagacgtacgtacgttacgtccgcgtacgtacgtacgtacggtacgtcgtcg

SEQ ID NO: 149240 - DNA, 431 bp, Homo sapiens
  misc_feature: GYAE6OF02G3ZIG.42.41.D08.1.454.CMB.1.raw
  modified_base (222)..(222): a, c, t, g, unknown or other
  misc_feature (222)..(222): n is a, c, g, or t
  modified_base (423)..(431): a, c, t, g, unknown or other
  misc_feature (423)..(431): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaagntcgtgggcgtacaggttcgtttgactacgtggggtcagggaaccctggtcaccgtctcctcagcctccaccaagggccccatcggtcttccccctggccgcccctgcctccaggagccacctccgagagcacagcggccctgggctgcctggtcaaggctactccacatacgtcactgagcgggctggcaaggcgcatagnnnnnnnnn

SEQ ID NO: 149241 - DNA, 433 bp, Homo sapiens
  misc_feature: GYAE6OF02F6Z1U.42.41.D08.1.454.CMB.1.raw
  modified_base (421)..(433): a, c, t, g, unknown or other
  misc_feature (421)..(433): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagatctgggcgtacaggttcgtttgactactggggtcagggaacccctggtcaccgtctcctcagcctccaccaaggccccatcggtcttcccccctggcgcccctgctccaggagcacctccgagagcacagcggccctgggctgcctggtcaaggactacttccacatacgtcactgagcgggctggcaaggcgcatacgnnnnnnnnnnnnn

SEQ ID NO: 149242 - DNA, 767 bp, Homo sapiens
  misc_feature: GYAE6OF02JCF4C.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttcctacattcggtacctgcagtgtagttttggggacttataacgttctttcctccagaccgacgggccccacgtcctctattttgaggctaggtcgacggggtccctcgacggtcctttggtcgtccgcgtccgacgttcgtcgggccgacgacgggtaccctccgtacgtacgtaactccggtacccggaccttccgacggtcgtacggaaccgttaccgtacggtacgttacgttacgttacggttaccgtaccgtcctagtacgttcgtacgtaccgaccgtaacgtccgtaggtaccgttaacgtttccgtcccgtccgtaaccgaactaaccttcgtaccgtacggtacctaccgtacggtaccgtaaggtaaccggaacgtaccggtaacgttaacgtttaacgtttacggtaacgtttaccgttaaccgttaaagggtttccgttaacgtttccgttaacttaccgttaaccgttaaccggttaccggtttaaccctaccgtttacggtacctaccggttacccgaacgggttccccttccccggttaccccggttaccgg

SEQ ID NO: 149243 - DNA, 662 bp, Homo sapiens
  misc_feature: GYAE6OF02H7QDW.42.41.D08.1.454.CMB.1.raw
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgcagtgtagttttggggcgttataacgttatttccttcccagacgacggggccccctaagtcctctatttttgaggcagtgacgggccctnaggtcctttgngcgcctccgagtctggcgacacggcctccctgacaatccgtccggactccgaggctcgacgactacggtgtacttcgtattaccgtcgctcatgctgacctagtctggctaagttcggtcctccctagactaacttcctcgtacgactccgaggtctaggtaacgaccgtaacggtaccgtaaagtttacgtttaacggttacgtttaccgtaagtttaaaggtttcgtaacgtttaccggttacttaagtttcctaacgttaccggtaaccccgtttacccgttaccgttaccaaccggtacccccgtaaagggtccctttaccccggccccccgtttacccggg

SEQ ID NO: 149244 - DNA, 940 bp, Homo sapiens
  misc_feature: GYAE6OF02JQRBL.42.41.D08.1.454.CMB.1.raw
  modified_base (676)..(676): a, c, t, g, unknown or other
  misc_feature (676)..(676): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgctatccgtgtctgggtctacgtggacagtcgatcatctatttcctacattggtacctgctaggttggttagttttggggcttaattaacggtttactttcccgttaccagaccggtaaccgggggtacccccctaaacggttcccttaccttacgtttttacgggacgggaccgtaaggttcggggtaaccggggtcccctacggtacgggttccgttttacggtacggtcccggtccggttacccggtcggttccggttacgggacccggaaacggtaccggggtcccctcccggttacgacccgtaaacgttccggtccccgggtaacctcccggtaacggtaccgttccggaaaccggtaaccgttaccgggtacgttaacgtttaccggtttaaacgtttcccgggtccgtacgttacggtaaccgttcggtaccgttacccggtaccgtaaacggtttcccgaggggtttaacccttaaacggtttcccgggttaccccttcccggttaanaacccggtttaatcccgttccgtttaaccggccgttaaaccgtgggtaccctagggtaaccacggtaaaccgttacgtaacgttttaaagtaccgggttttacgtaaccggtttacggttaaactttacggttaccggttttaacctacgtttaccggttactttaaccggtaccggttaacccccgtttaccgttaaccggttacccgtaacggtaaccccgtaacgggtttccccccttaccgggttcccccccggttaacg

SEQ ID NO: 149245 - DNA, 659 bp, Homo sapiens
  misc_feature: GYAE6OF02GCHMY.42.41.D08.1.454.CMB.1.raw
  modified_base (210)..(210): a, c, t, g, unknown or other
  misc_feature (210)..(210): n is a, c, g, or t
  modified_base (573)..(573): a, c, t, g, unknown or other
  misc_feature (573)..(573): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
  modified_base (615)..(615): a, c, t, g, unknown or other
  misc_feature (615)..(615): n is a, c, g, or t
  modified_base (623)..(623): a, c, t, g, unknown or other
  misc_feature (623)..(623): n is a, c, g, or t
  modified_base (631)..(631): a, c, t, g, unknown or other
  misc_feature (631)..(631): n is a, c, g, or t
  modified_base (643)..(643): a, c, t, g, unknown or other
  misc_feature (643)..(643): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctcagagacacgccaagaacacgttgtatctaggaaatgaacatcgtgggagccgaggacacggctgtcttatttcngtagtaaaagcttcgtgggcgtacgaggtttcgttgacttacgtggggtcaacgggtaaccctggtaccacccgttcctcctcgacgtccctaccgaacccgtaaggcccctacgttccggttcctttaccccccgtggtacccgtccccgtacgtccgtaccgaacggacgcccgtaccgtaccgacgtacgaccgaccgacggccccggtacccgtgggaccgttcggtccgttacggtaccgaaacggttcccttaaacccgttccgaaacctttaaccggtacgttacctaacggttacggaaccgggtcggggtacgttacgggaaccgtacgggtcccgtaacgaacggtacgacgnacgtcgagtgacgcgcgtacagnagtgngatgcgngcgcagncgtgacgngagacgcncgacgtctcgtntcgtcatcnctcgngc

SEQ ID NO: 149246 - DNA, 522 bp, Homo sapiens
  misc_feature: GYAE6OF02IN0GK.42.41.D08.1.454.CMB.1.raw
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (480)..(480): a, c, t, g, unknown or other
  misc_feature (480)..(480): n is a, c, g, or t
  modified_base (483)..(522): a, c, t, g, unknown or other
  misc_feature (483)..(522): n is a, c, g, or t
tcagtgacgtatgtcacgaccggtgctcgatttagtcacgcgagaaagggaaaggggctggtgtgggtctcagctgttattggtgatggagtaacacaagatacggggactccgtgaagggccattcagcatctccagagacaacgccaagaacacgttgtatctggaaatgaaacatctggganccgaggacacggntgtctatttcngtagtaaaagtcngggtcgtanaggttcgttgactacgtgggtcagggaccctggtcaccgtctcctcagtcctccaccgaagggccccatcggtaccttcccccgtggcnccctgcctcgaggacncaccgttccgagacgcaanacggcccggtccctcgggactcggacccgtcgggtacaaacgggtcttaacgtttcccgaaactacttaaccgtacaaccgttagacgggtccgggacctgggaccgtaaaggccgcaagtagtngannnnnnnnnnnnnnnnnnnnnnnnnnnnnnnnnnnnnnnn

SEQ ID NO: 149247 - DNA, 661 bp, Homo sapiens
  misc_feature: GYAE6OF02IHZRG.42.41.D08.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(661): a, c, t, g, unknown or other
  misc_feature (625)..(661): n is a, c, g, or t
tcagtgacgtatgtcacgaccggtgctcgatttagtcacgcgagaaagggaaaggggctggtgtgggtctcagctgttattggtgatgggagtaacacaagatacggggactccgtggaagggccgattcagcatctccagagacaacgccaagaacacgttgtatctggaaatgaaacaatccgtgggagccgaggacncggctgtctatttctagtagtaaaaagntcgtgggacggtaacgtagggtttcgtttgaaccttacggtgggggtccaacggggaccctggggttaccaccgttccgttccctcgacgtccctcccaaccgaaaccggggcccctaagttcccgggttccctttcccccccgtgggcccgtcccccttcggtacccttccccggaagggaccgtcctaaccccgttcccggaaaggaccggaccgaaccgtacgggccccggggtcccggtcggggtcctcggtaccccttggggtaccgaaacgggtacctttaaccccgttacccgaactacgttaaccggttacctaaccggttggacgggttcccgggggcgttacgggaccggtaaacggggccccgtaatacgtaacgagcacgngncnnnnnnnnnnnnnnnnnnnnnnnnnnnnnnnnnnnnn

SEQ ID NO: 149248 - DNA, 537 bp, Homo sapiens
  misc_feature: GYAE6OF02JC5ZU.42.41.D08.1.454.CMB.1.raw
  modified_base (515)..(517): a, c, t, g, unknown or other
  misc_feature (515)..(517): n is a, c, g, or t
  modified_base (520)..(537): a, c, t, g, unknown or other
  misc_feature (520)..(537): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacgggctgtcttatttctgtagtaaaagatcgtgggcggtacgtagggtttcgtttgactacgtgggggtacgagggaacccgtggtccaccgtcctcctcacgccctcccgaaccgaacgggccccagttccggttcccttcccccgtggcccgtcccgtcgcctaccgacgggacgccaccgtaccgaggacgcaacgacggcccggcccgtgggcctccggccgtgggtaccgacggaaccttaccgttacccaactacgttaaccgtcaccgtggacgggtccgggacgtcgggaccgaaagggccgaacagtagnnngcnnnnnnnnnnnnnnnnnn

SEQ ID NO: 149249 - DNA, 614 bp, Homo sapiens
  misc_feature: GYAE6OF02IIHZN.42.41.D08.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (520)..(520): a, c, t, g, unknown or other
  misc_feature (520)..(520): n is a, c, g, or t
  modified_base (541)..(541): a, c, t, g, unknown or other
  misc_feature (541)..(541): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (582)..(582): a, c, t, g, unknown or other
  misc_feature (582)..(582): n is a, c, g, or t
  modified_base (584)..(614): a, c, t, g, unknown or other
  misc_feature (584)..(614): n is a, c, g, or t
tcagtgacgtatgtcacgaccggtgctcgatttagtcacgcgagaaagggaaaggggctggtgtgggtctcagctgtttattggtgatgggagtaacacaagagtacgggggactccggtggaagggccattcagcatctcagagacaacgccaagaacacgttgtatctaggaaatagaaacaattcgaggggacgccggaaggaccacggctgtcttactttntgtagtaaaagntcgtgggacggtactagggtttcgtttgaacgttcgnggggtacaacggggtaccctggtaccaccgtcctccgtcacgccctaccaaccgaacggccctagtcccggttcccttcccccgtcggcccgtcccctcggtacctccggacgggaccgacccgtacccgacccggaaggacccgacgaaccggacggtcccgggcccgttcgggcctcggtacccggttacggacgtaacggtaccctttaccgttaccgaacgtaccgttacctaccgtaccgngggtaaggcccggggttccgngggtaaccgacggggcccacggtaaagtccgngncngnngngnnnnnnnnnnnnnnnnnnnnnnnnnnnnnnn

SEQ ID NO: 149250 - DNA, 129 bp, Homo sapiens
  misc_feature: GYAE6OF02HENUU.42.41.D08.1.454.CMB.1.raw
  modified_base (123)..(129): a, c, t, g, unknown or other
  misc_feature (123)..(129): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcacnnnnnnn

SEQ ID NO: 149251 - DNA, 568 bp, Homo sapiens
  misc_feature: GYAE6OF02GRS51.42.41.D08.1.454.CMB.1.raw
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (457)..(457): a, c, t, g, unknown or other
  misc_feature (457)..(457): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (530)..(531): a, c, t, g, unknown or other
  misc_feature (530)..(531): n is a, c, g, or t
  modified_base (533)..(568): a, c, t, g, unknown or other
  misc_feature (533)..(568): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctggaaatgaacaatctggganccgaggacacggtctgtcttatttctgtagtaaaagntcgtgggacgtagtacggtttcgtttacgactacggtgggtacgaacgggacccgtggtaccaccgttccnccacgcgtcccctccaacggtaaccggcccacgtccgtacccttcccccggtgacccgtccccgtgaccctacgacggacgccacccgttccggaagcgacctacgaccggccggtacccgtgggcctacgtccgttacgacgaacggtacttacccgttanataccgtacgtacacgttaggaccgggtcggcgtaccggaagaccggtcggactagtaccggntcagngtacnngnnnnnnnnnnnnnnnnnnnnnnnnnnnnnnnnnnnn

SEQ ID NO: 149252 - DNA, 515 bp, Homo sapiens
  misc_feature: GYAE6OF02JY4ZL.42.41.D08.1.454.CMB.1.raw
  modified_base (225)..(225): a, c, t, g, unknown or other
  misc_feature (225)..(225): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
  modified_base (500)..(515): a, c, t, g, unknown or other
  misc_feature (500)..(515): n is a, c, g, or t
tcagtgacgtatgtcacgaccggtgctcgatttagtcacgcgagaaagggaaagggggctggtgtgggtctcagctgttattggtgatgggagtaacacaagatacggggactccgtgaagggccgattcagcatctcagagacaacgccaagaacacgttgtatctaggaaatgaacaatcgtgggacgcgaggacgacggctgtctatttctgtagtaaaagntcgtgggcggtacgtaggttgttagactacggtgggtacgacgggaacctgtaccgaccgtctacctcgacgccctaccgaaccgacgggccctagtccggtcccttcccccggtgcccgtcccgtcgcctaccgacgggtacgccaacccgtcggaaccgtggaccctaacggcgggcccggtacccgtgggcctccggaccgtcggtaacggaccgtacgtactccaaacgtctacgtcaacgnggacggcggtcgaggcgaggccgangcgnnnnnnnnnnnnnnnn

SEQ ID NO: 149253 - DNA, 498 bp, Homo sapiens
  misc_feature: GYAE6OF02JU3BT.42.41.D08.1.454.CMB.1.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
  modified_base (458)..(461): a, c, t, g, unknown or other
  misc_feature (458)..(461): n is a, c, g, or t
  modified_base (464)..(465): a, c, t, g, unknown or other
  misc_feature (464)..(465): n is a, c, g, or t
  modified_base (468)..(470): a, c, t, g, unknown or other
  misc_feature (468)..(470): n is a, c, g, or t
  modified_base (473)..(498): a, c, t, g, unknown or other
  misc_feature (473)..(498): n is a, c, g, or t
tcagtgacgtatgtcacgaccggtgctcgatttagtcacgcgagaaagggaaaggggcgtggtgtgggtctcagctgttattggtgatgggagtaacacaagatacggggactccgtgaagggccgattcagcatctccagagacaacgccaagaacacgttgatctaggaaatgaacaatctggganccgaggacacggctgtctattcngtagtaaaagntcgtggggcgtacaggtttcgtttgacttacgtggggtcaacgggaccctggtccaccgttcnccgtcagccctaccacgtaacggccctagtccggttcccttccccgnggcccgccctgcctcccgaggcnccgacccncggaacgcncacgcgccggccgtggcncgtcgngtacgacgctctaccatacgtcgtaccagngagggtccgggntcggacacggcgntaacggnnnncgnngannnacnnnnnnnnnnnnnnnnnnnnnnnnnn

SEQ ID NO: 149254 - DNA, 874 bp, Homo sapiens
  misc_feature: GYAE6OF02FL7ZU.42.41.D08.1.454.CMB.1.raw
  modified_base (208)..(208): a, c, t, g, unknown or other
  misc_feature (208)..(208): n is a, c, g, or t
tcagtgacgtatgtcacgaccggtgctcgatttagtcacgcgagaaagggaaaggggggggggtcacaagaggcagcgctctcgggacgtctccaccatggcctgggctctgctactcctcactctccttactcaggacacagggtcgtgggcccagtctgcatccgtgtcgtgggtctactgggacagtcgatcatctatttcctanattggtacctgctagtgtagttttcgggggcttaagttaaccgtttactttccttacccaagtaccgaccggggcccccctaacgttccctactacgtttttggacgggtcctaggtcgggtacggggtccccttcgtacgggtccttttggcgtccggtccttccggagtccgtcgggaccgtacgaccggggtccctcccggtgtaactaacgtccgtacccggtacctaccgtacggtcttacggaaccgtacgttacgggtcgtaacgttacggttacgtttaccgtccgtacgttaccgacgttcgtacgtaccggacccgtaaaggttccggtacgggttaaccttaacgggttttcccgggtacccctttaccccgtaagggtaaccctaacgtttcccgttaccggttacccgggtacccttccccgggaaggttacccgtaaacggggtaacccggaaacccgggtaaccggttaaccgtttaaacgtttttaacggttacggttaaccggtttccgttaaacgttttaaggttccgttaacgtttacccgtaagtaccgtttacgtaaccggttacccggtaccccgtttacggtacccgttacgacccggtttaccgaaccggttccccgttacccggtaccccccgtttaccgg

SEQ ID NO: 149255 - DNA, 548 bp, Homo sapiens
  misc_feature: GYAE6OF02JXGWL.42.41.D08.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (324)..(324): a, c, t, g, unknown or other
  misc_feature (324)..(324): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (513)..(513): a, c, t, g, unknown or other
  misc_feature (513)..(513): n is a, c, g, or t
  modified_base (516)..(519): a, c, t, g, unknown or other
  misc_feature (516)..(519): n is a, c, g, or t
  modified_base (521)..(548): a, c, t, g, unknown or other
  misc_feature (521)..(548): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctcagagacacgccaagaacacgttgtatctggaaatgaacaatcgtggganccgaggacacggctgtcttatttcngtacgtaaaagntctggggcgttactagggtttctttgacttagtggggtcagggaaccctggcctacgtctcctcacgcctccgactacgggcccaagtccgtccttccccngccgcccgtgcctcccgaggccgcacccgtccgagacgccacaccggtccggcccgtggggtccncggtcccgtggtaccgaacggtacttcccgttacccaacgtattaaccgtccgaacgttcggacgggcccgggtacgtacgggaccgagggaccgtacgaggtaacggtacgnagngnngcgcngcnnnncnnnnnnnnnnnnnnnnnnnnnnnnnnnn

SEQ ID NO: 149256 - DNA, 814 bp, Homo sapiens
  misc_feature: GYAE6OF02IH1US.42.41.D08.1.454.CMB.1.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
tcagtgacgtatgtcacgaccggtgctcgatttagtcacgcgagaaagggaaaggggggggggtcacaagaggcagcgctctcgggacgtctccaccatggcctgggctctgctactctcactctccttactcaggacacagggtcgtgggcccagtctgcatccgtgtcngggtctactggacagtccgatccatcacgtttcctacnttcggtacctggcagtgattttgggggcttataacgttacttccttcccgagtacgacgggggaccccccaacggtccctactacgtttttaggaggggtctacggttaggaacgggggtccccccttacgaaggggttcccttttcgggtacgtaccggtccgtaacccgggacggttcgtcggggtaccgtaacggaacgggggttcccctcccgttacggaaccaaacgtttcgtacccggacgttccgaacggtctaggaaccgaacgttaacggtacgttacgttacggttaacttacggttacggtcttacgtaatcgggcttacggacccgtaagttcctaggaactaacgtttcggcccttacccctaagggtaacccaacgttccgtacttacgggtaccctccgtacgtaccgtaacggtaaacgggaccgtaaaccgtaacggttaacgttacgtttaaggtacccggtttaactacgttaaacgtttcgtaaccgttcgttaacctaacggttctaaggttcccgtaacccgttccggtaaccgttacccaaggtaccccgttaaaggggcccttaccggacccccgtttcgg

SEQ ID NO: 149257 - DNA, 591 bp, Homo sapiens
  misc_feature: GYAE6OF02GLKY7.42.41.D08.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (435)..(435): a, c, t, g, unknown or other
  misc_feature (435)..(435): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (559)..(559): a, c, t, g, unknown or other
  misc_feature (559)..(559): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaaggccgattcagcatctcagagacaacgccaagacacgttganctggaaatgaacatcgtggganccgagacacggctgtctatttcngtagaaaantctgggacgtcaggttcctttgactagtggggtcacgggaacctgggtccaccgtctctcagcctccgacaacggcccagtcgtccttccccnggccgccttcgctccgtagacgtccaacctcgagancctacgaggccgtccgtagggctcgtaccgngttaacaacggtcctaaccgttccaagtacgtaccgtactaaccgtaggagtacccgggngtccggataacgggacgtaccgagtacggacgngttacgctagacnggactncgancgcttagcgnganacgtancgtagntanaccgtgacgttcgacgtacgtcgtagaccgtacgttacgngtaccgtaacgtcgtagtacgacgtacgtacg

SEQ ID NO: 149258 - DNA, 506 bp, Homo sapiens
  misc_feature: GYAE6OF02GIW1X.42.41.D08.1.454.CMB.1.raw
  modified_base (132)..(132): a, c, t, g, unknown or other
  misc_feature (132)..(132): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (490)..(506): a, c, t, g, unknown or other
  misc_feature (490)..(506): n is a, c, g, or t
tcagtgacgtatgtcacgaccggtgctcgatttagtcacgcgagaaagggaaagggggctggtgtgggtctcagctgttattggtgatgggagtaacacaagatacggggactccgtgaagggccattcagnatctccagagacaacgccaagaacacgttgtatctaggaaatgaaacaatcgtggggagccgaggacacggctgtctatttcngtagtaaaagntcgtgggcgtactggtttcgttgactacgtggggtcagggaccctggtccaccgtctcctcacgcctccaccgacggcccacgtccggtcccttcccccgtcggtccgcccgtcgcctccgacggacgccgacccgttttttttttttttaccgacgacgacgacgacggccggcccgtcgggccgtcgccgtcggtacgacggactacttacctacactacgtctacgtcggacggcgggcgtcggacgacggcgacagtagnnnnnnnnnnnnnnnnn

SEQ ID NO: 149259 - DNA, 739 bp, Homo sapiens
  misc_feature: GYAE6OF02GOA68.42.41.D08.1.454.CMB.1.raw
  modified_base (259)..(259): a, c, t, g, unknown or other
  misc_feature (259)..(259): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctccttactcagacacgagggtcgtgggccctagtcctgcagtccgtgtctgggtctactggacagtcgatcatctatttcctactatttcggacctgctagttcgtagttttcggggacttaattaaccggtttntttcccttccgaggaccgtaccggggacccccctaaggtcctcttagtttttcggacgggtctaggtcggaacggggtcccctacgacgggtccttttggacggtccgtccgtccggtagtccgtgggtccgacggtacggtcccttcctagacctatccgtaccgactccgacggtcttgaaccgtcgtacggttgtacgttcgttaattaccgtcgcgttacagtcgactcgtaccgtaacgtcgtacggtacttacggtttccgtccccgttacgtaccgtactaaccttcgtacgtacgttacctccgaagtcgtaacggaacgaccgacgtaccgttattttaggttaacgttacgttccgttaaacgtttagttaacgttcgttacttactactttacgtaacggttccgtaacccgttaccttacggtaccgtacgtacccgacggttaccgtccccggaccccgtttaccgg

SEQ ID NO: 149260 - DNA, 754 bp, Homo sapiens
  misc_feature: GYAE6OF02FVWMC.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctggtctactggacagtcgatcatctatttccctacagtttcggtacctgctagtggtagttttcggggcgttaattaacgtttactttcccttacccgagtaccgaccgggggaccccccaacggtcccttctaatttttgagggtcaggtcgaggggccctgacggtcctttgtgcgtcgtccgagtctgggaccgacgacgggtccctccgtgacctaagttcccgtaccggtacctaccgacggtcctaggaccgtaacggttaaccggttggtaactttacggtttacgttaaccgttccgtacttacgtagtttacgccgtacgaccgtaaggtccgtggtaccgttacggtttcgtacccgttcccgtaacgacgtaacttccgttacgtcgtacccttaccgtagaccgtaaggaaaccgccgacggtacgtattttaacgttaaggtacgtttccgaaggttttacgtagtttaccttacggttaactacgttacgtaacgttaccggacccgtttacccgttaccggtacaaccgggttacccgaacggtcccgtccccgtcccccgttaccggg

SEQ ID NO: 149261 - DNA, 743 bp, Homo sapiens
  misc_feature: GYAE6OF02JFMUO.42.41.D08.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (592)..(592): a, c, t, g, unknown or other
  misc_feature (592)..(592): n is a, c, g, or t
  modified_base (650)..(650): a, c, t, g, unknown or other
  misc_feature (650)..(650): n is a, c, g, or t
tcagtgacgtatgtcacgaccggtgctcgatttagtcacgcgagaaaggggaaagggggggggtcacaagaggcagcgctctcgggacgtctccaccatggcctggctctgctactcctcactctccttactcacggacacagggtcggtcgggccctagtctgctactccgtgtcgtggtctacgtggacagtcgatcgatctatttcctactagttcggtaccngacngtcggtagtttgggcgttaattaacgtttacttcccgttccagaccgtaccgggaccccctaacgtcctattacttttggaggtctaggtacggacgggtcccctacgacgttccgttgtcgtccgccgtacgcgtgcggacgacgacggcctccgagtacacgtccgtaccgactcgagcgtacgacgtacgtaggtagtacgttcgtaagttccgtcgtactcgtacgttcggacttacgtacccgtaaggtttccgtagggtacctttacgttacccgggttacccgttaaccgtccgtaaaccgttaactttccggttacgttccggtaacctccgtaaccggtgaaaccggggtaanaccgtaacccgtagttaaacgttagtttaagtccgtttaacggtattttaaacggttntaccgtttacttacggtacttaacgtacggttaccggtaccgttccgttacgaccgacgtacccggtaagtcccgtcccgtaccccggttacg

SEQ ID NO: 149262 - DNA, 878 bp, Homo sapiens
  misc_feature: GYAE6OF02I4P60.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatctatttcctactattcggtacctgctagttgtagtttttcgggggactttaagttaacgtttacttttcccttacccgaaggtaccgtaaccggggggtaccccccctaaacggttccccgttccttaaggtttttttcgggaacgggggtcctaaggttacggggtacggggggtacccccgttaccggtaacggggtcccgttttttcggtacgggttccggtccggtttaccccggaacggtttcgttccggggccggtaaaccgtaacgggggtcccccttacccgtacgtaaccgtaaacgttcccggttacccggtacctacccggacggtaccgtacggtaccggtaacgttaacgggtacgtacgtttacgttacgtttaaccggtcgaccgttcagttcgacgttccgaccgtaagttccgtacggtcttaagtttcccggacccttccgtacgtaaccgaacttcctacggttacgaccgttacggtacggtacctaacgggaaacggtaccgaaccgtaacgttatttaacggtttacgttacggtttacgttaacgtttaacgttagttactttacgtacgttatccgttacggtaccgttaacccggtttccttaccgttaccgaaccgttacccggaaggttcccgttacccggttcccccgttaaccgg

SEQ ID NO: 149263 - DNA, 472 bp, Homo sapiens
  misc_feature: GYAE6OF02GES17.42.41.D08.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (455)..(472): a, c, t, g, unknown or other
  misc_feature (455)..(472): n is a, c, g, or t
tcagtgacgtatgtcacgaccggtgctcgatttagtcacgcgagaaagggaaaggggctggtgtgggtctcagctgttattggtgatgggagtaacacaagatacggggactccgtgaagggccgattcagcatctccagagacaacgccaagaacacgttgtatctaggaaatgaacaatctgggagccgaggacacggctgtctatttctgtagtaaaagatcgtgggcggtacaggtttcgtttgactacgtggggtcaagggaaccctggtccaccgtctcctcacgcctccaccgaacgggccccatccggtccttccccccgtggcccgtccctggcctccgagggacnccaccgtccggagacgcaacgnggccggcctgggctcgcctggcaacggactactccacatacgtcacttggacggcggctggacgaaggcacgatacgnnnnnnnnnnnnnnnnnn

SEQ ID NO: 149264 - DNA, 889 bp, Homo sapiens
  misc_feature: GYAE6OF02IFUE8.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacgagggtcgtcggcccagtctgctactccgtgtcgtggtctagtggacagtcgtatcactctactttcctactagtttcggtacctgcagttggttaggttttgggtacgttaacgtttaaacgttttaccttttcccgttacccgaaggacccggacccggggtaacccccctaacgttccttacctttacggtttttacggacgggtacgtacgggtcgggaccggggtccccttacggtaccggttccgttttcggtacggtccggtcccgtacccggttcggttaccggttcgggtaccggtaaccggtaccgggtccccgttaccccgttacgaaaccttacgttacccgttacccggtacccgttccgggaccggttccgtaaccgggtaaccggttaacgttaccgggtacgtttaccgtttaccggttaaacgtttacccggtccgtaccgtctaacgtcgtaccgtacgtaccgtaacggttcctacggtaacgtttaacgtttcccggacccgttcccgtaacggtaaaccttaccgttccgttaccggtcgtacccgttaccgacgggttccgaaacgtaaccggaacgtaaccggttaagtacgtttaggtttaacggttacgtttacgttaacgtttaagttcgttaacgttacgtacttacgttcgtaccgttaccgtaccgttaccttaccggtactacccggtaacctacccgtccgtcccgtaccccgtcccg

SEQ ID NO: 149265 - DNA, 635 bp, Homo sapiens
  misc_feature: GYAE6OF02JXJB8.42.41.D08.1.454.CMB.1.raw
  modified_base (184)..(184): a, c, t, g, unknown or other
  misc_feature (184)..(184): n is a, c, g, or t
  modified_base (224)..(224): a, c, t, g, unknown or other
  misc_feature (224)..(224): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (580)..(582): a, c, t, g, unknown or other
  misc_feature (580)..(582): n is a, c, g, or t
  modified_base (587)..(588): a, c, t, g, unknown or other
  misc_feature (587)..(588): n is a, c, g, or t
  modified_base (595)..(595): a, c, t, g, unknown or other
  misc_feature (595)..(595): n is a, c, g, or t
  modified_base (599)..(600): a, c, t, g, unknown or other
  misc_feature (599)..(600): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(615): a, c, t, g, unknown or other
  misc_feature (611)..(615): n is a, c, g, or t
  modified_base (617)..(617): a, c, t, g, unknown or other
  misc_feature (617)..(617): n is a, c, g, or t
  modified_base (619)..(625): a, c, t, g, unknown or other
  misc_feature (619)..(625): n is a, c, g, or t
  modified_base (627)..(627): a, c, t, g, unknown or other
  misc_feature (627)..(627): n is a, c, g, or t
  modified_base (630)..(635): a, c, t, g, unknown or other
  misc_feature (630)..(635): n is a, c, g, or t
tcagtgacgtatgtcacgaccggtgctcgatttagtcacgcgagaaagggaaaggggctggtgtgggtctcagctgttattggtgatgggagtaacacaagatacggggactccgtggaagggccgatttcagcatcctcagagacaacgccaagaacacgttgatctggaaatgaacaatcgngggagccgaggacacggctgtctatttctgtagtaaaagntcgtgggcggtacaggtttcgttagactaccggtggggtccgagggtaaccccgttggccaccgttctacctcacgcctaccaaccgaacgggccccctagttccggtaccctttcccccggagggtcccggcccctttgggccctttaccggacgggtacgtcccaaccccgtccgggaacgactccgaaccgtacgggcccggtaccccgggtcgggccctcgtcccggttagggggttccaaaccgggtaccttttacccgtaccaacctattacccgggtaccgaattcggggaacggtcccggggacgttaggaccgaaacgggcgtcgtaaaggtctaagnacacncgtnnngcgannatatcgngagnngtgtacncncnnnnncncnnnnnnncncgnnnnnn

SEQ ID NO: 149266 - DNA, 479 bp, Homo sapiens
  misc_feature: GYAE6OF02HWY0G.42.41.D08.1.454.CMB.1.raw
  modified_base (225)..(225): a, c, t, g, unknown or other
  misc_feature (225)..(225): n is a, c, g, or t
  modified_base (453)..(453): a, c, t, g, unknown or other
  misc_feature (453)..(453): n is a, c, g, or t
  modified_base (455)..(479): a, c, t, g, unknown or other
  misc_feature (455)..(479): n is a, c, g, or t
tcagtgacgtatgtcacgaccggtgctcgatttagtcacgcgagaaagggaaagggctggtgtgggtctcagctgttattggtgatgggagtaacacaagatacggggactccgtgaagggccgattcagcatctcagagacaacgccaaagaacacgttgtatctaggaaaatgaaacaatctgggagccgaggacacggctgtctatttcagtagtaaaaagntcgtgggcgtaacagggtttctttagactaacgtgggggtacaacgggtaaccctggtccaccgtctcctcaagcctccaaccaagggccccatccggtcttccccctggccgccctgctccgaggcgcacctccgagagcacacgccgcctagggctcgccgtggtaccaaacggtactaacccttccaacatacgttcactgaggcggctggacaaggcgcatagnannnnnnnnnnnnnnnnnnnnnnnnn

SEQ ID NO: 149267 - DNA, 553 bp, Homo sapiens
  misc_feature: GYAE6OF02FOED3.42.41.D08.1.454.CMB.1.raw
  modified_base (225)..(225): a, c, t, g, unknown or other
  misc_feature (225)..(225): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (517)..(553): a, c, t, g, unknown or other
  misc_feature (517)..(553): n is a, c, g, or t
tcagtgacgtatgtcacgaccggtgctcgatttagtcacgcgagaaagggaaaggggctggtgtgggtctcagctgttattggtgatgggagtaaacacaagatacggggactccgtgaagggccgattcagcatctcagagacaacgccaagaacacgttgatctaggaaatgaaacaatctgggagccgaaggacacggctgtctatttctgtagtaaaaagntcgtaggggcgttacagggttcctttggaccttagtggggtcaagggaaccctggtcaccggttcctccgtacgacgtccctaccgaaccgaaaggggcccctagttaccggtaccctttcccccccgtggggcctacccccgttgacccctacccgaagggtcaccctaccgtccgaagacgcaacgcggcggtcccgtggctgccgttggtacaaggtactaccttccacagttcgctaactggacgcgggctacggagaacggtccgacaactaggntcganacnacgnnnnnnnnnnnnnnnnnnnnnnnnnnnnnnnnnnnnn

SEQ ID NO: 149268 - DNA, 578 bp, Homo sapiens
  misc_feature: GYAE6OF02FG4JN.42.41.D08.1.454.CMB.1.raw
  modified_base (444)..(445): a, c, t, g, unknown or other
  misc_feature (444)..(445): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
tcagtgacgtatgtcacgaccggtgctcgatttagtcacgcgagaaagggaaagggggggggtcacaagaggcagcgctctcgggacgtctccaccatggcctgggctctgctactcctcactctcctactcaggacacagggtcgtggcccagtctgcatccgtgtctgggtctactggacagtcgatcatctactttcctacagttggtacctgctagtgtagttttggggcttaattaacgttactttccttacccgagaccgaccggggtacccccaacgttcccttctagttttgacgggtctagtggacggggtccctagacggtcctttagtcgccgtctccgtggtactcgggaccacgacgggtccctcccgtagactaagtccgccgtactccgaggtctcggacgacgtacggtgtattcgtattacgcgctnntgctcgctagtcaggctagttcgccgtctcactatctntcgctcngtcagagcgagactatagttagtacgtntattagtnttacgtnatagtcnttcgacctctagcgaccgcgtacgcctaccgtccctcg

SEQ ID NO: 149269 - DNA, 779 bp, Homo sapiens
  misc_feature: GYAE6OF02FQLKM.42.41.D08.1.454.CMB.1.raw
  modified_base (631)..(631): a, c, t, g, unknown or other
  misc_feature (631)..(631): n is a, c, g, or t
tcagtgacgtatgtcacgaccggtgctcgatttagtcacgcgagaaaggggaaaggggggggggtcacaagaggcagcgctctcgggacgtctccaccatggcctgggctctgctactcctcactctccttactcaggacacgaggggtcgtgggcccagtctgcatccgtgtctgggtctacgtggactagtcgatcatctatttcctactagtttcggtacctgccaggttcgtaggttttgggggacttaagttaaaccggttttactttccccgttacccgaaggtaccggaacccggggggtaccccccctaaacggttccccttacgttaacgtttttacgggaacgggtaccgtaagggtacggtaaccgggggtaccccctcgtacgggttcccgttttaggtaccggtccggtaccgttaccggtacggttaccgttacgggacccggaacggtaaccggggtcccttacccgaacgtaacccgttaacggttccgttacccggacttaccggaggtaccggtacgtaccggtaacgtaccgttagggtactttacgtaacgttacgtcggtctacgtagtcgctacgactaaggtctagtactacgttcggacctaccgtnactactcgtcgtagtaccctgactgtaacggaacgtacgtaaccggtataatttaagtaggtacttacgtatttacggtatattacgacttagtcgtactaccgtacctacgttacgtccacgtaccgaggtcctaccgtcccgtacg

SEQ ID NO: 149270 - DNA, 765 bp, Homo sapiens
  misc_feature: GYAE6OF02IIV19.42.41.D08.1.454.CMB.1.raw
tcagtgacgtatgtcacgaccggtgctcgatttagtcacgcgagaaagggaaagggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttcctacattggtacctgctagtgagttttggggactattaacgttatttcccttacccagaccgtacggggccccccaacgttcctcctatttttcgaagggtcaggtcggacggggcccgtcgacggtcccgttttgtcgtccggtcctccggtaggttccgtgggcgaccgtacggggtccctcccgtggtaacaacgttccgtcccgggtaaccttcccgaacgggtccttcggaaaccggtaccgttaccggggtacgtaccggttttacgttaaccggtttaaccggttcgtcccttcgactttccggtaccgttcggtaccctaaacgggttcgtacgggtaaccttaaaggtttttccggcccttacccgttcgaaccgtaactttccgtcgtacggtaccttacccgacggtacgtacggtaacgacgtacggtagtacttaaggtttacgtacgtttctaacgtttagttacgacgtttacgtactagtttcgtaatcggttaccccgttaccttacggtccgtacgtcccggaaccgtccctcgtcccccgtaccgg

SEQ ID NO: 149271 - DNA, 651 bp, Homo sapiens
  misc_feature: GYAE6OF02JQZG5.42.41.D08.1.454.CMB.1.raw
  modified_base (109)..(109): a, c, t, g, unknown or other
  misc_feature (109)..(109): n is a, c, g, or t
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
  modified_base (605)..(605): a, c, t, g, unknown or other
  misc_feature (605)..(605): n is a, c, g, or t
  modified_base (618)..(623): a, c, t, g, unknown or other
  misc_feature (618)..(623): n is a, c, g, or t
  modified_base (625)..(651): a, c, t, g, unknown or other
  misc_feature (625)..(651): n is a, c, g, or t
tcagtgacgtatgtcacgaccggtgctcgatttagtcacgcgagaaagggaaaggggctgggtgtgggtctcagctgttattggtgatgggagtaacacaagataccgngggactccgtgaacggggccgatttcagcatctaccagacgacaaccgccaaagaacacgttgactcgtacggaaatgaactagtccgtggggagccggaagaccgacggtctgttccttatttcgtgttaggtaaaaaagtcttcggtaggggccgggttaacctagggttttccggtttanaccggtttacggtggggggttaccaacgggaacccccgttggtaccctacccggtcttcccctnaccggtacccttccggaaccgtaaccggggcccctaggttccggtcccttaccccggtggaccctcccccggttgcctaacccggagggtcccaccgtacccgtccgggagtacggacaaccgtacggtcccggaccgtcgggctccgtccgtaggtaccgaacggtacctttacgaccaacgtacgtaccgttccacggtacggaacgggttcgggcgtacggaccgtcggggacaacgttacagtcngcaggctagcagnnnnnncnnnnnnnnnnnnnnnnnnnnnnnnnnn

SEQ ID NO: 149272 - DNA, 312 bp, Homo sapiens
  misc_feature: GYAE6OF01BLXPO.25.49.E05.1.454.CMB.1.raw
  modified_base (310)..(312): a, c, t, g, unknown or other
  misc_feature (310)..(312): n is a, c, g, or t
tcagactgtacagtcacgaccggtgctcgatttagagcgactagcaacacacaaagggggacgggatccctgatcgcttctcaggctccagctgtgggactgagcgctacctcaccatcctccagcctccagtctgaggatgaaactgactattactgtcagaccgtggggcactggcattcgagggtgttcggcggagggaccagctgaccgtcctgggtcacgcccgaaggcctcgcccccgtcggtcactctcgttccccgccctcctcactgtacagtcctggagcgggctggcaaggcgcatagnnn

SEQ ID NO: 149273 - DNA, 312 bp, Homo sapiens
  misc_feature: GYAE6OF01AM2WF.25.49.E05.1.454.CMB.1.raw
  modified_base (294)..(294): a, c, t, g, unknown or other
  misc_feature (294)..(294): n is a, c, g, or t
  modified_base (300)..(312): a, c, t, g, unknown or other
  misc_feature (300)..(312): n is a, c, g, or t
tcagactgtacagtcacgaccggtgctcgatttagagcgactagcaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaaggctgaccgtcctaggtcagcccaaggctcgccccctcggtcactctgttcccgccctcctcactgtacagtctgagcgggctggcaggcncatagnnnnnnnnnnnnn

SEQ ID NO: 149274 - DNA, 304 bp, Homo sapiens
  misc_feature: GYAE6OF01D83DZ.25.49.E05.1.454.CMB.1.raw
  modified_base (300)..(304): a, c, t, g, unknown or other
  misc_feature (300)..(304): n is a, c, g, or t
tcagactgtacagtcacgaccggtgctcgatttagagcgactagcaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtactaggtcagcccaaggctcgccccctcggtcactctcgttcccgccctcctcactgtacagtctgagcggctggcaaggcgcatagnnnnn

SEQ ID NO: 149275 - DNA, 140 bp, Homo sapiens
  misc_feature: GYAE6OF02JFWV1.25.49.E05.1.454.CMB.1.raw
  modified_base (138)..(140): a, c, t, g, unknown or other
  misc_feature (138)..(140): n is a, c, g, or t
tcagactgtacagtcacgaccggtgctcgatttagagcgactagcaacacacaaagggggacggatccctgatcgcttctcaggctccagctgtggactgagcgctacctcaccatctccagcctcagtctgaggatnnn

SEQ ID NO: 149276 - DNA, 504 bp, Homo sapiens
  misc_feature: GYAE6OF01EC1OO.21.59.F04.1.454.CMB.1.raw
  modified_base (408)..(408): a, c, t, g, unknown or other
  misc_feature (408)..(408): n is a, c, g, or t
  modified_base (473)..(473): a, c, t, g, unknown or other
  misc_feature (473)..(473): n is a, c, g, or t
  modified_base (501)..(501): a, c, t, g, unknown or other
  misc_feature (501)..(501): n is a, c, g, or t
tcagtcgtcgctcgcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagttagaagtgaggtccatcaaggttcggcggcagtggatcgtgggacagaattcactctcacatcagcagcctgcagcctgatgtatttgactaacttntactgaccaatagtattaattcgtttccgtaggtacgttcggacgaaagggacctaagggtcganatacaaacgtatggtcgctagctacctntcg

SEQ ID NO: 149277 - DNA, 928 bp, Homo sapiens
  misc_feature: GYAE6OF01D4QYF.21.59.F04.1.454.CMB.1.raw
  modified_base (106)..(106): a, c, t, g, unknown or other
  misc_feature (106)..(106): n is a, c, g, or t
tcagtcgtcgctcgcacgaccggtgctcgatttagtacacacacttagggattgggggcaggagtcagacccagtcaggacacagcatggacatgagggtccccgntcagctcctggggctcctgctggctctcggctcccgaggtcgaccaatgtagactactccagactcggaccctacgttccttacccttcctacgttgtcgtctagctattcgtaggtacggtgaacgagtacgtcacctacttccgtacgttccggccggtactaggtcgtaagtagttacttaggtacgtgttcgggttcgtccgttaggtactacgacgaccgtaaacggtaaacccggaaggtaaacccgtacccgttaacgtcccttacgtacgtacttaacggttaacgtaccgggttcgtttaaacgttaaggtttaacggaaacggttcggtaccgtaccgtagtacgggtaacggtcgggacgtacgtaggtacggtactcgggtaacggaccttaaagttacccttccgtaacccgttcctaaccggtaaccacggttaccggacccgttaacgtccggttaccgactacgggtaacccgttcgggttaacgttaaacgtttcggttttaacgttttaaccggaacccttttttaaaccgtttacgttaacccgaaccgtttaaacctaaacggttttaaccgtttaaacgtttttaaaccggtttttacccggggtttaaccgggtaacggggtttaaccccgggtttaacccggggaaaccggggtttaaacccggtaacggggtttaaaccgggtaacgtaaacccggtttaaaaccgaaaccgggtaaaacccgggtttcggggtacccgttaaaccggttacccgttaacggttacccccgttaaaggttcccggtttttaaacccgg

SEQ ID NO: 149278 - DNA, 512 bp, Homo sapiens
  misc_feature: GYAE6OF02FMXAQ.21.59.F04.1.454.CMB.1.raw
tcagtcgtcgctcgcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggccttggtatcagcagaaaccagggaaagcccctaagctcctgatctataaggcgtctagtttagaaagtgaggtcccatcaaggttcggcggcagtggatcgtgggacagaattcactctcaccatcagcagcctgcagcctgatgtattttgctaacttattactgaccaatagttaataattacgtttaccgtggtacgttcggaccagggacctaggtcggactagtacaacgtacgtgtcggctgactacctatcg

SEQ ID NO: 149279 - DNA, 296 bp, Homo sapiens
  misc_feature: GYAE6OF01AYPPM.2.36.D03.1.454.CMB.1.raw
  modified_base (290)..(296): a, c, t, g, unknown or other
  misc_feature (290)..(296): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttcatcttcccgccatctgatgtcgagcgtctgagcgggctggcaaggcgcatagnnnnnnn

SEQ ID NO: 149280 - DNA, 296 bp, Homo sapiens; identical to SEQ ID NO: 149279
  misc_feature: GYAE6OF01BUKF9.2.36.D03.1.454.CMB.1.raw
  modified_base (290)..(296): a, c, t, g, unknown or other
  misc_feature (290)..(296): n is a, c, g, or t

SEQ ID NO: 149281 - DNA, 291 bp, Homo sapiens
  misc_feature: GYAE6OF01AE59C.2.36.D03.1.454.CMB.1.raw
  modified_base (289)..(291): a, c, t, g, unknown or other
  misc_feature (289)..(291): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttcatcttcccgccatctgagtcgagcgtctgagcgggctggcaaggcgcatagnnn

SEQ ID NO: 149282 - DNA, 292 bp, Homo sapiens
  misc_feature: GYAE6OF01CU5CH.2.36.D03.1.454.CMB.1.raw
  modified_base (289)..(292): a, c, t, g, unknown or other
  misc_feature (289)..(292): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgactgtggctgcaccatctgtcttcatcttcccgcatctgatgtcgagcgtctggagcgggctggcaaggcgcatagnnnn

SEQ ID NO: 149283 - DNA, 294 bp, Homo sapiens
  misc_feature: GYAE6OF01BFGI4.2.36.D03.1.454.CMB.1.raw
  modified_base (289)..(294): a, c, t, g, unknown or other
  misc_feature (289)..(294): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttcatcttcccgcatctgatgtcgagcgtctgagcgggctggcaaggcgcatagnnnnnn

SEQ ID NO: 149284 - DNA, 304 bp, Homo sapiens
  misc_feature: GYAE6OF01DS5VY.2.36.D03.1.454.CMB.1.raw
  modified_base (295)..(304): a, c, t, g, unknown or other
  misc_feature (295)..(304): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgctacgtttggccaggggaccaaggtagagatcaaacgaactgtggctgcacatctgtctcatccttcccgcatctgatgtcgagcgtctgacggcgggctggaccaaggcgcaagtgcnnnnnnnnnn

SEQ ID NO: 149285 - DNA, 301 bp, Homo sapiens
  misc_feature: GYAE6OF01C59PJ.2.36.D03.1.454.CMB.1.raw
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
  modified_base (295)..(301): a, c, t, g, unknown or other
  misc_feature (295)..(301): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgtctacgtttggccaggggaccaaggtagagatacaaacgactgtggctgcaccntctgtcttcatccttcccgcctatctgatgtcgagcgtctgaggcgggctggcaaggcncatagnnnnnnn

SEQ ID NO: 149286 - DNA, 344 bp, Homo sapiens
  misc_feature: GYAE6OF01CTZF3.2.36.D03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (310)..(312): a, c, t, g, unknown or other
  misc_feature (310)..(312): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (319)..(344): a, c, t, g, unknown or other
  misc_feature (319)..(344): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgactaaacttactattgtcaagtagtttcttaattcctttcccgcgtctacggtttggccaggggaccaaggtagagatacgaaacgactggtggctgcaccatcngtcttcattctcccgactatctgatgtcgagcgtcnggacggngggctaggacgaggcgtacatgnnncngcntnnnnnnnnnnnnnnnnnnnnnnnnnn

SEQ ID NO: 149287 - DNA, 445 bp, Homo sapiens
  misc_feature: GYAE6OF01A43SA.2.36.D03.1.454.CMB.1.raw
  modified_base (392)..(392): a, c, t, g, unknown or other
  misc_feature (392)..(392): n is a, c, g, or t
  modified_base (398)..(403): a, c, t, g, unknown or other
  misc_feature (398)..(403): n is a, c, g, or t
  modified_base (405)..(445): a, c, t, g, unknown or other
  misc_feature (405)..(445): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgctaacttactattgtacagacgtttctaagtttcctttccccggcgtcgtaccggttttgggacccgtaacgggggacctaaaaggtaggagtactaaccgaaaccggtaactgggttacggcttacggacccaccgtaagttcgtacggttcttacgtaaccttcccttccccggcctataccgtgtattcggtctaggccgttcgttaggccggtcgggtcgtacggcgtaacggccgtcaagtaggctgngtacgnnnnnngnnnnnnnnnnnnnnnnnnnnnnnnnnnnnnnnnnnnnnnnn

SEQ ID NO: 149288 - DNA, 293 bp, Homo sapiens
  misc_feature: GYAE6OF02IXDGR.2.36.D03.1.454.CMB.1.raw
  modified_base (290)..(293): a, c, t, g, unknown or other
  misc_feature (290)..(293): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttcatcttcccgccatctgatgtcgagcgtctgagcgggctggcaaggcgcatagnnnn

SEQ ID NO: 149289 - DNA, 299 bp, Homo sapiens
  misc_feature: GYAE6OF02I2ZEB.2.36.D03.1.454.CMB.1.raw
  modified_base (283)..(283): a, c, t, g, unknown or other
  misc_feature (283)..(283): n is a, c, g, or t
  modified_base (289)..(299): a, c, t, g, unknown or other
  misc_feature (289)..(299): n is a, c, g, or t
tcagacgctcgacacacgaccggtgctcgatttagctgcgtcacgatctcgtcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgactgtgctgcaccatctgtcttcatcttcccgccatctgatgtcgagcgtctgagcgggctggcaaggcncatagnnnnnnnnnnn

SEQ ID NO: 149290 - DNA, 294 bp, Homo sapiens
  misc_feature: GYAE6OF02FZAXO.2.36.D03.1.454.CMB.1.raw
  modified_base (289)..(294): a, c, t, g, unknown or other
  misc_feature (289)..(294): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttcatcttccgccatctgatgtcgagcgtctgagcgggctggcaaggcgcatagnnnnnn

SEQ ID NO: 149291 - DNA, 300 bp, Homo sapiens
  misc_feature: GYAE6OF02HMS9M.2.36.D03.1.454.CMB.1.raw
  modified_base (290)..(300): a, c, t, g, unknown or other
  misc_feature (290)..(300): n is a, c, g, or t
tcagacgctcgacacacgaccggtgctcgatttagctgcgtcacgatctctcttgggatagaagttattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgaactgtggctgcaccatctgtcttaatcttcccgccatctgatgtcgagcgtctgagcgggctggcaaggcgcatagnnnnnnnnnnn

SEQ ID NO: 149292 - DNA, 443 bp, Homo sapiens
  misc_feature: GYAE6OF01DMGSS.44.60.F05.1.454.CMB.1.raw
  modified_base (431)..(431): a, c, t, g, unknown or other
  misc_feature (431)..(431): n is a, c, g, or t
  modified_base (437)..(443): a, c, t, g, unknown or other
  misc_feature (437)..(443): n is a, c, g, or t
tcagacagtatatacacgaccggtgctcgatttagtacgtcatcagggaaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctggggctgcctggtcaaggctacttcctatatactgtctgagcgggctgggcaaggcncatagnnnnnnn

SEQ ID NO: 149293 - DNA, 445 bp, Homo sapiens
  misc_feature: GYAE6OF01D3M55.44.60.F05.1.454.CMB.1.raw
  modified_base (388)..(388): a, c, t, g, unknown or other
  misc_feature (388)..(388): n is a, c, g, or t
  modified_base (414)..(415): a, c, t, g, unknown or other
  misc_feature (414)..(415): n is a, c, g, or t
  modified_base (417)..(435): a, c, t, g, unknown or other
  misc_feature (417)..(435): n is a, c, g, or t
  modified_base (437)..(445): a, c, t, g, unknown or other
  misc_feature (437)..(445): n is a, c, g, or t
tcagacagtatatacacgaccggtgctcgatttagtacgtcatcagggaaagaggccaccctctcctgcagggccaggtcagagtgttgccaaaaactacttagtctcggttccagcagtaaaccctggccagactcccaggctcctcatctatgatgcatccaacagggtcactggcaccccagacaggtttcagtggcagtgggtctgggacagacttcactctcaccgtcagcaatgttacagcctgaagattttagactagtttattactgtcagcagcgttacctcgaggccgctcacgtttcggcgggggaccaaggtggtagagtcagacgaacgtgtcggctgcacatctgtcttcatcttccgcatctgatatatactntctgagcggctggcaaggcacagtgnngnnnnnnnnnnnnnnnnnnngnnnnnnnnn

SEQ ID NO: 149294 - DNA, 404 bp, Homo sapiens
  misc_feature: GYAE6OF01AJ66N.44.60.F05.1.454.CMB.1.raw
  modified_base (398)..(404): a, c, t, g, unknown or other
  misc_feature (398)..(404): n is a, c, g, or t
tcagacagtatatacacgaccggtgctcgatttagtacgtcatcagggaaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaccctggtcaccgtctcctcagcctccaccaagggcccatcggtctcccctggcgccctgctccaggagcacctccgagagcacagcggcctgggctgcctggtcaaggactacttcctatatactgtctgagcgggtctggcaaggcgcatagnnnnnnn

SEQ ID NO: 149295 - DNA, 448 bp, Homo sapiens
  misc_feature: GYAE6OF01B8BNM.44.60.F05.1.454.CMB.1.raw
  modified_base (185)..(185): a, c, t, g, unknown or other
  misc_feature (185)..(185): n is a, c, g, or t
  modified_base (245)..(245): a, c, t, g, unknown or other
  misc_feature (245)..(245): n is a, c, g, or t
  modified_base (415)..(422): a, c, t, g, unknown or other
  misc_feature (415)..(422): n is a, c, g, or t
  modified_base (424)..(448): a, c, t, g, unknown or other
  misc_feature (424)..(448): n is a, c, g, or t
tcagacagtatatacacgaccggtgctcgatttagtacgtcatcagggaaagagccaccctctcctgcagggccagtcagacgtgttgccaaaaactacttagtctggttccagcagaaacctggccagactcccaggctcctcatctatggtgcatcccagccagggcctctggcatcccgganaggttcagtggcaggtgggtctggggacagacttcgactctcaccatcagcagactggancctgaacgtattttgcagtgtattactgtcagcagtatgcttactcacctcgtgacgtttcggaccaagggaccaagggtgaaatcaaaacgtactgtcggctgcaccatctgtcttcatcttccgcatctgatatatactgtctgagcggtctggacaaggcgcatagnnnnnnnntnnnnnnnnnnnnnnnnnnnnnnnnn

SEQ ID NO: 149296 - DNA, 435 bp, Homo sapiens
  misc_feature: GYAE6OF01CVY9O.44.60.F05.1.454.CMB.1.raw
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
  modified_base (412)..(435): a, c, t, g, unknown or other
  misc_feature (412)..(435): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcaggtgggtctgggacagacttcactctcaccatcagcagactggancctagaagtattttgctagtttattactgtcagcagtataatgactgcctcctcgccaaggacacgactgganataaacgatgtgctgcaccatctgtcttcacttcttcccgctatctagatatatactgtctaggacggcgggtctggaccgaaggtccgacgtagtagnnnnnnnnnnnnnnnnnnnnnnnn

SEQ ID NO: 149297 - DNA, 421 bp, Homo sapiens
  misc_feature: GYAE6OF01EANQ7.44.60.F05.1.454.CMB.1.raw
  modified_base (409)..(409): a, c, t, g, unknown or other
  misc_feature (409)..(409): n is a, c, g, or t
  modified_base (414)..(421): a, c, t, g, unknown or other
  misc_feature (414)..(421): n is a, c, g, or t
tcagacagtatatacacgaccggtgctcgatttagtacgtcatcagggaaagagccaccctctcctgcagggccagtcagagtgttggcagcagcgtagcctggttccagcagaaacctggccagactcccaggctcctcatctataccacatccaccagggccactggtatcccagccagattcagtggcactggggtctgggacagagttcactctcaccatcagcagcctgcagtctgaagattttgctagtttattactgtctagcagttatagtgactggcctccgttcacgtttccggccctgggacctacagttcgatttcaaacgaactggtggctgcaccatctgtcttcctatcctcccgccatctgatatatctgcgtgagcgggctggtacaggcgnatagnnnnnnnn

SEQ ID NO: 149298 - DNA, 440 bp, Homo sapiens
  misc_feature: GYAE6OF01C34MK.44.60.F05.1.454.CMB.1.raw
  modified_base (219)..(219): a, c, t, g, unknown or other
  misc_feature (219)..(219): n is a, c, g, or t
  modified_base (428)..(428): a, c, t, g, unknown or other
  misc_feature (428)..(428): n is a, c, g, or t
  modified_base (431)..(440): a, c, t, g, unknown or other
  misc_feature (431)..(440): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaaagaacacgctgtatctgcaaatgaacagtctgagagccgaggacacggctgtgtattactgtgcaaagngccggtgcgggagttcggggattgcatactatactacggtatggacgtctgggcaagggaccacggtcaccgtctcctcagcttccaccaagggcccatccggtcttccccctgcgccctgctccaggagcacctcgtggggcacagcgcctgggctgctgtcaaggctacttccagtctatcgctgagcgggactgggcaaggcgcanagnnnnnnnnnn

SEQ ID NO: 149299 - DNA, 466 bp, Homo sapiens
  misc_feature: GYAE6OF01CHJ6C.44.60.F05.1.454.CMB.1.raw
  modified_base (448)..(448): a, c, t, g, unknown or other
  misc_feature (448)..(448): n is a, c, g, or t
  modified_base (453)..(466): a, c, t, g, unknown or other
  misc_feature (453)..(466): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaagggcccatcggtcttccccctggccgccctgctccaggcgccacctcgtcgggggcacaggccggccctggggcctcgccctgggtcaagggaccttacgttcccacgttctacgtgctgagcgggctggcaaggcncatgnnnnnnnnnnnnnn

SEQ ID NO: 149300 - DNA, 451 bp, Homo sapiens
  misc_feature: GYAE6OF01A9EC5.44.60.F05.1.454.CMB.1.raw
  modified_base (438)..(451): a, c, t, g, unknown or other
  misc_feature (438)..(451): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaaggcccatcggtcttccccctggcgccctgctccaggagcacctctgggggcacagcggccctgggctgcctggtcaaggactactttccacgtctactgctgagcgggctgggcaaggcgcatagnnnnnnnnnnnnnn

SEQ ID NO: 149301 - DNA, 722 bp, Homo sapiens
  misc_feature: GYAE6OF01BT4AD.44.60.F05.1.454.CMB.1.raw
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (693)..(694): a, c, t, g, unknown or other
  misc_feature (693)..(694): n is a, c, g, or t
  modified_base (696)..(696): a, c, t, g, unknown or other
  misc_feature (696)..(696): n is a, c, g, or t
  modified_base (698)..(720): a, c, t, g, unknown or other
  misc_feature (698)..(720): n is a, c, g, or t
  modified_base (722)..(722): a, c, t, g, unknown or other
  misc_feature (722)..(722): n is a, c, g, or t
tcagacagtatatacacgaccggtgctcgatttagtacgtcatcagggaaagagccaccctctcctgcagggccagtcagagtgttgccaaaaaactacttagtctggttcccagcagaaacccgtgaccagtaccctcccgaggtcccttcctactacttacttaggttgggtacactacctaccgaggacggtaccgggtcccttcggacggcctacccggtacccccggaaggttacggttacgtagggtcggacgtaggggttccgggtcgtacggggaacctacgttaccttaccaccttccacccaactactacggacgacgtaacggtacggtacgggaccgtaccgttaagggtaaatttttcgtttcgacggttaggtttacgttaaccgtttgtcgtacgagtaccgtaagttactcgttacctttaccaccctcttacggtacggttaccgggtacccgaaccgggaacggtaacggttaagggtaaacgtaaactaaaccgaaaacgttcgtcgggtacgtactacgaaccctacgtacttcgttacttccgttacacccgttttcccccgacccgtacgttacttcggtaattaacttacttaaaccgttcgttactcgggtacggacgggtccggtacggtaccgggaacgttacggccgtaataacgggcntnagatnngntnnnnnnnnnnnnnnnnnnnnnnngn

SEQ ID NO: 149302 - DNA, 449 bp, Homo sapiens
  misc_feature: GYAE6OF01BZMBO.44.60.F05.1.454.CMB.1.raw
  modified_base (247)..(247): a, c, t, g, unknown or other
  misc_feature (247)..(247): n is a, c, g, or t
  modified_base (404)..(404): a, c, t, g, unknown or other
  misc_feature (404)..(404): n is a, c, g, or t
  modified_base (426)..(449): a, c, t, g, unknown or other
  misc_feature (426)..(449): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccaacagggtcactggcaccccagacaggttcagtgcagtgggtctgggacagacttcactctcaccgtcagcaatgtacagcctgaagtnttttgctagtttattactgtcagcagtccgttcctccgaggccgctcgtaccgttcgggcgggggaccaagggtggagtatcgaggacgaacgtgtcggctgcacatcgtgtcttcacttcctcccgctatctgactatatactgtctgacgcggtntggacgaaggcgactagtcgannnnnnnnnnnnnnnnnnnnnnnn

SEQ ID NO: 149303 - DNA, 709 bp, Homo sapiens
  misc_feature: GYAE6OF01DQHZ3.44.60.F05.1.454.CMB.1.raw
  modified_base (143)..(143): a, c, t, g, unknown or other
  misc_feature (143)..(143): n is a, c, g, or t
  modified_base (265)..(265): a, c, t, g, unknown or other
  misc_feature (265)..(265): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (690)..(690): a, c, t, g, unknown or other
  misc_feature (690)..(690): n is a, c, g, or t
  modified_base (703)..(703): a, c, t, g, unknown or other
  misc_feature (703)..(703): n is a, c, g, or t
tcagacagtatatacacgaccggtgctcgatttagtacgtcatcagggaaagagccaaccctctcctgcagggcccagtcagagtgttgaccaaaaactacttagtctggttccaagcagaaaacccgtcggaccaacgaccnccgaggtcctacctacactacttaggtggtcacactaccgagacggtaccggtcctcggtcgactaccggtacccggagtacgttacgaggtcgcgtaggtggtcgtagggacagtactacnctcaccaacatacgaacagaacgagtacggactcgtaataaagtttctttagacgtaagttacttattagttacgagaacgacgtaattcgtacgttactttacctaccgtaaccttcgtaacgggttaccggttacccggaaccggtaaaccggaaacggtaacgggttaaaagaaacggttaaaaccgaaccgttacggtaggtaccgtacgttacgaaacctcgtacgtttcgttaacttccttaaccgtctaccccggttacccacctaacttacaggtaacttaagttaaccttaacgtcgttacggtacggtaccggtacgggttaacggacggtaacgtaaccgggtcgaacgtaagtacggattcggacagcgaanatagncgananangacgactagatagtacatactgtagtanacatactatacgngtagac

SEQ ID NO: 149304 - DNA, 605 bp, Homo sapiens
  misc_feature: GYAE6OF01CFPGN.44.60.F05.1.454.CMB.1.raw
  modified_base (202)..(202): a, c, t, g, unknown or other
  misc_feature (202)..(202): n is a, c, g, or t
  modified_base (578)..(578): a, c, t, g, unknown or other
  misc_feature (578)..(578): n is a, c, g, or t
  modified_base (581)..(605): a, c, t, g, unknown or other
  misc_feature (581)..(605): n is a, c, g, or t
tcagacagtatatacacgaccggtgctcgatttagtacgtcatcagggaaaggggctggtgtgggtctcacgtattaatagtgatgggagtagcacaagctacgcggactccgtgaaggccgattcaccatctccagagacaacgccaagaacacgctgtatctgacaaatgaacagtctgagagccgaggacacggctgtntattactgtgacaagacggccgggtggcggggtaggttcgggggtagttgcaacttacctaacgtacgttacggttagtggaccgttggtcggggaccgaaacgggaccgaccggtccgacccgttcctccctcacgtcctacccaccggaaccggccctacggttcccggtcccttcccccgcgggcccctcccgtcgtccgtaccgacggaccgtacccgtcccggtcggtcgggggacccaccggtacggtccccgggtcccggtcgggtcctccggtacccggtacggtaccgtaacgttacccgttaccgttcttaagttactacgttctcggaggtccggcgggttcgcggacgtacggctacgagtagntgnnnnnnnnnnnnnnnnnnnnnnnnn

SEQ ID NO: 149305 - DNA, 574 bp, Homo sapiens
  misc_feature: GYAE6OF01D39JI.44.60.F05.1.454.CMB.1.raw
  modified_base (366)..(366): a, c, t, g, unknown or other
  misc_feature (366)..(366): n is a, c, g, or t
  modified_base (546)..(549): a, c, t, g, unknown or other
  misc_feature (546)..(549): n is a, c, g, or t
  modified_base (551)..(574): a, c, t, g, unknown or other
  misc_feature (551)..(574): n is a, c, g, or t
tcagacagtatatacacgaccggtgctcgatttagtacgtcatcagggaaaggggctggtgtgggtctcacgtattaatagtgatgggagtagcacaagctacgcggactccgtgaaggccgattcaccatctccagagacaacgccaagaacacgctgtatctgacaaaatgaacagtctgagagccggaggacacggctgtgttattactgtgacaaggtacgccgggtagcggggtaggttcggggtagttgacatactactacgtaggtatggacgtcgtcggggaccgtaagggaccacggtccaccgtctcctcacgtcctccaccgacggccctacgtccggttcctcccgagcggccncccgtcgcctccgaggcgccgtacccgtcggcggggacctacgacggcccggaccggtcgggctcggtccgttacgggaccgaacgtacctttaccgttaccctaagttacgttacttcggtcgtacgggtacgggcccgggtcgtacgggaccggaacgggccgtacgtaagttacggnnnngnnnnnnnnnnnnnnnnnnnnnnnn

SEQ ID NO: 149306 - DNA, 407 bp, Homo sapiens
  misc_feature: GYAE6OF02HX2FL.44.60.F05.1.454.CMB.1.raw
  modified_base (402)..(407): a, c, t, g, unknown or other
  misc_feature (402)..(407): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtgtattactgtcagcagtatgcttactcacctctgacgtttcggccaagggccaaggtggaaatcaaacgaactgtggctgcaccatctgtcttcatcttcccgccatctgatatatactgtctgagcgggctggcaagcgcatagnnnnnn

SEQ ID NO: 149307 - DNA, 426 bp, Homo sapiens
  misc_feature: GYAE6OF02FK6HF.44.60.F05.1.454.CMB.1.raw
  modified_base (403)..(426): a, c, t, g, unknown or other
  misc_feature (403)..(426): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtgtattactgtcagcagtatgcttactcacctctgacgttcggccaagggaccaaggtggaaatcaaacgaactgtggctgcaccatctgtcttcatcttcccgccatctgatatatactgtctgagcgggctggcaaggcgcatagnnnnnnnnnnnnnnnnnnnnnnnn

SEQ ID NO: 149308 - DNA, 408 bp, Homo sapiens
  misc_feature: GYAE6OF02G822V.44.60.F05.1.454.CMB.1.raw
  modified_base (400)..(408): a, c, t, g, unknown or other
  misc_feature (400)..(408): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtttatgactgtcagcagcgtagcaactggccgatcaccttcggccaagggacacgactggagattaaacgaactgtggctgcacatctgtctcatcttcccgcatctgatatatactgtctgagcgggctggcaaggcgcatagnnnnnnnnn

SEQ ID NO: 149309 - DNA, 407 bp, Homo sapiens
  misc_feature: GYAE6OF02FVZ0O.44.60.F05.1.454.CMB.1.raw
  modified_base (403)..(407): a, c, t, g, unknown or other
  misc_feature (403)..(407): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtgtattactgtcagcagtatgtttactcacctctgacgttcggccaagggaccaaggtggaaatcaaacgaactgtggctgcaccatctgtcttcatcttcccgccatctgatatatactgtctgagcgggctggcaaggcgcatagnnnnn

SEQ ID NO: 149310 - DNA, 439 bp, Homo sapiens
  misc_feature: GYAE6OF02GF7DP.44.60.F05.1.454.CMB.1.raw
  modified_base (436)..(439): a, c, t, g, unknown or other
  misc_feature (436)..(439): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnn

SEQ ID NO: 149311 - DNA, 441 bp, Homo sapiens
  misc_feature: GYAE6OF02IFNJF.44.60.F05.1.454.CMB.1.raw
  modified_base (436)..(441): a, c, t, g, unknown or other
  misc_feature (436)..(441): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnnnn

SEQ ID NO: 149312 - DNA, 445 bp, Homo sapiens
  misc_feature: GYAE6OF02GYDHT.44.60.F05.1.454.CMB.1.raw
  modified_base (437)..(445): a, c, t, g, unknown or other
  misc_feature (437)..(445): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnn

SEQ ID NO: 149313 - DNA, 405 bp, Homo sapiens
  misc_feature: GYAE6OF02I89TJ.44.60.F05.1.454.CMB.1.raw
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (396)..(405): a, c, t, g, unknown or other
  misc_feature (396)..(405): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtgtattactgtcagcagtatgcttactcacctctgacgttcggccaagggaccaaggtggaaatcaaacgactgngctgcacatcngtctcatcttccgcatctgatatatactgtctgagcggctggacaggcgcatagnnnnnnnnnn

SEQ ID NO: 149314 - DNA, 447 bp, Homo sapiens
  misc_feature: GYAE6OF02IB5E8.44.60.F05.1.454.CMB.1.raw
  modified_base (435)..(447): a, c, t, g, unknown or other
  misc_feature (435)..(447): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaaagaacacgctgtatctgcaaatgaacagtctgagagccgaggacacggctgtgtattactgtgcaaagagccggtgcgggagttcggggagttgcatactactactacggtatggacgtctggggccaagggaccacggtcacgtctcctcagcttccaccaaggcccatcggtcttcccctgcgcctgctccaggagcacctctggggcacagcggccctggggctgcctggtcaaggactacttccacgtctactgctgagcgggctggcaaggcgcatacgnnnnnnnnnnnnn

SEQ ID NO: 149315 - DNA, 438 bp, Homo sapiens
  misc_feature: GYAE6OF02HIVLT.44.60.F05.1.454.CMB.1.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcggggagttcggggagttgcatactactactacggtatggacgtcgtggggccaagggaccacggtcaccgtctcctcagcttccacagggcccatcggtctcccctgcncctgctccagngcactcgtggggcacngcggcctgggctgcctggtcaaggctacttcctatatactgtctgagcgggctggcaaggcncatagnnnnnnnnnn

SEQ ID NO: 149316 - DNA, 448 bp, Homo sapiens
  misc_feature: GYAE6OF02G94BL.44.60.F05.1.454.CMB.1.raw
  modified_base (350)..(350): a, c, t, g, unknown or other
  misc_feature (350)..(350): n is a, c, g, or t
  modified_base (435)..(448): a, c, t, g, unknown or other
  misc_feature (435)..(448): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggngcacctctgggggcacagcggccctgggctgcctggtcaaggctacttcctatatactgtctgagcgggctggcaaggcgcatgnnnnnnnnnnnnnn

SEQ ID NO: 149317 - DNA, 625 bp, Homo sapiens
  misc_feature: GYAE6OF02H51HA.44.60.F05.1.454.CMB.1.raw
  modified_base (543)..(543): a, c, t, g, unknown or other
  misc_feature (543)..(543): n is a, c, g, or t
  modified_base (554)..(554): a, c, t, g, unknown or other
  misc_feature (554)..(554): n is a, c, g, or t
  modified_base (593)..(593): a, c, t, g, unknown or other
  misc_feature (593)..(593): n is a, c, g, or t
tcagacagtatatacacgaccggtgctcgatttagtacgtcatcagggaaaggggctggtgtgggtctcacgtattaatagtgatgggagtagcacaagctacgcggactccgtgaagggccgattcaccatctcagagacaacgccaagaacacgctgtatctgcaaatgaacagtctgagagccgaggacacggctgtgtattactgtgcaagacgccggtgcgggtagttcggggagttgctatactactacgtacggtagtcggacgtcgtggggaccaagggaccacggtccaccgtctcctacacgtccttaccaccgaacggccctacgttccggttccttcccccgtggccgtcccgtcgcctcgacggtacgcctaccgtccgagacgacacgacggccggccgtcgggctcgccgttgggtaccgaaacggtaccttaccgtttcccgtaccggtacgtcccggtacggttcgtacgggacgggtccggggtacgttacgggaacggtaacgggccgtaccgttaacgacggngtacggcacgngtccgagtcgctcgtcgcgtcgacgcgtacgtcgtctcncgtcgtcgcgcgtcgtcgtcgtcgtcgtagcg

SEQ ID NO: 149318 - DNA, 453 bp, Homo sapiens
  misc_feature: GYAE6OF02HKXRY.44.60.F05.1.454.CMB.1.raw
  modified_base (182)..(182): a, c, t, g, unknown or other
  misc_feature (182)..(182): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (440)..(453): a, c, t, g, unknown or other
  misc_feature (440)..(453): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccgganaggttcagtggcagtgggtctgggacagacttcactctcaccatcagcagactggagcctgaagtattttgctagtgtattactgtcagcagtattgacttacctcacctctcggtacgttcggaccgaagggtaccaagggtaggaaactacgaaaacgaactggtacggctagcacctatctgtcttcactccgttcccncctattctgtatactatactntctgacgcgggtcgtcggcgaacggcgacgatagnnnnnnnnnnnnnn

SEQ ID NO: 149319 - DNA, 500 bp, Homo sapiens
  misc_feature: GYAE6OF02GWUG2.44.60.F05.1.454.CMB.1.raw
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (476)..(485): a, c, t, g, unknown or other
  misc_feature (476)..(485): n is a, c, g, or t
  modified_base (487)..(500): a, c, t, g, unknown or other
  misc_feature (487)..(500): n is a, c, g, or t
tcagacagtatatacacgaccggtgctcgatttagtacgtcatcagggaaagagccaccctctcctgcagggccagtcagagtgttagcagcaacttagccctcgtaccagcagaaatctggccaggctcccaggctcctcatctatggtgcatccaccagggccactggtatcccagccaggttcagtggcagtgggtctgggacagtagttcactctcacatcagcagcctgctagtctaggaagtattttgactagttttatgtactgtcagacagtcgtagaccgaacgtcggacctatacctaccgttcggaccaacgggacacggtaacgtggaacgtaacttaaaacgtacgtgtaggactagaccactatctcgttccttactacttcctcccgactactctagtatatatacttgtctgtaggccggtcgtaggacgtaacggcgtaccaagttangntacngacannnnnnnnnngnnnnnnnnnnnnnn

SEQ ID NO: 149320 - DNA, 431 bp, Homo sapiens
  misc_feature: GYAE6OF02FNH6W.44.60.F05.1.454.CMB.1.raw
  modified_base (419)..(431): a, c, t, g, unknown or other
  misc_feature (419)..(431): n is a, c, g, or t
tcagacagtatatacacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagtattttgctaacttattactgaccaacagtataagagttattctcagtagttttggccgaggggaccaagctggagatacaaaacgaactgtaggctgacacatctgtcttcactcttcccgcctatctagatatactactgtctacgagcggcgtggcaaggcgacagtagnnnnnnnnnnnnn

SEQ ID NO: 149321 - DNA, 725 bp, Homo sapiens
  misc_feature: GYAE6OF02G7P3B.44.60.F05.1.454.CMB.1.raw
  modified_base (99)..(99): a, c, t, g, unknown or other
  misc_feature (99)..(99): n is a, c, g, or t
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
  modified_base (713)..(713): a, c, t, g, unknown or other
  misc_feature (713)..(713): n is a, c, g, or t
tcagacagtatatacacgaccggtgctcgatttagtacgtcatcagggaaagggggaatcagtcccactcaggacacagcatggacatgagggtccccnctcagctcctggggctcctgctgctctggttcccgaggtgccaggtgtgacatccagatgacccagtctccatctgccatgtctgctattctggtagganacagacgtacaccatcacgtttggcgggcaggtcgaggctatacgattaagttattacgtccttaggttacgagtacgaagaaaccgaagggtaacctacccgtaaacnccgtatacttacttactcgtcgtacctacttaacgttaacgaacgggtacccgggttaccttaacgtaacgttaccgcggacgacgtagggtacgtacgtacgagggaactaagtacttacgtactcctaacgtaactactacgacgtcctacggtcctagaccgtaccgtaacggtacgttaaagtttacgttacctaacgtttaaacttttcttaacgtacgtttaaacttaactaacgttagttaacccgtaaccgtttaacccgttttggggacccggtttacccgggttaacgggaccccgtaaaaggggtaacccgtaaagggttaacctaacgggaaccggtaacgacgggttacgcggtacctcgtaaccctagtcttcggttaccgtcgtttaccnccgtttaacccc

SEQ ID NO: 149322 - DNA, 885 bp, Homo sapiens
  misc_feature: GYAE6OF02GWUEG.44.60.F05.1.454.CMB.1.raw
tcagacagtatatacacgaccggtgctcgatttagtacgtcatcagggaaagggggaatcagtcccactcaggacacagcatggacatgagggtccccgctcagctccgtggggctcctgctgctctggttcccaggtgccaggtgtgacatccagatcgacccagtctccatctcgcctatgtctgacagtctgtaggagacaggacgtaccacctactacctacgttggtccgggacgtacggtcggacggacttagtaacgacttaagtttagttacgtcgttacggttacacgacgaacgaaaaccggaacggtaaccgtaacccgtaacgtcgtacgtacttacgttactccgttacgtacccttacttaaccgttaacggaaccgggttacccgggttacccgttaagttaaacggttcggaacggtaccggtacggtacggtacgggtaccttaccgggtacgggtaaacgtacgtaaccgttaaccgtaccgtaaccgtacccgtaacctaacgttaccgaccgtacccgtacgtcccggttaaggaccccgttaaacggtaccgttaagtaacgttttaccggtttaaccgtaaacttttaaacccgggttttactttaaccgttaaccttagttaaaacctaacgttaacgtacccgttaccccgttaaacccgggtttaccgggttaaacggggttcccggttaacccgggggtacccgggtaaaccggtaaaccgggttaacgggttaaccgtaacgtaaaaccccggttaaggtaaccgggttccggttaacggtccgtaacccggtaacgttaccgtttaaccgttcgttaccgggttttacccttaaccggttcccccgtttaaccccgg

SEQ ID NO: 149323 - DNA, 487 bp, Homo sapiens
  misc_feature: GYAE6OF01AGXKN.8.73.G07.1.454.CMB.1.raw
  modified_base (476)..(487): a, c, t, g, unknown or other
  misc_feature (476)..(487): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctcgccccctcggtccactctcgttcccgccctctcgacacgcgagctgacgcggctggcaggcgcgagtagnnnnnnnnnnnn

SEQ ID NO: 149324 - DNA, 483 bp, Homo sapiens
  misc_feature: GYAE6OF01AHVWM.8.73.G07.1.454.CMB.1.raw
  modified_base (443)..(443): a, c, t, g, unknown or other
  misc_feature (443)..(443): n is a, c, g, or t
  modified_base (475)..(483): a, c, t, g, unknown or other
  misc_feature (475)..(483): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctcgccccctcggtcactctcgttcccgccctcctcgacncgcgagctgacgcggcgtggcaggcgcatagnnnnnnnnn

SEQ ID NO: 149325 - DNA, 491 bp, Homo sapiens
  misc_feature: GYAE6OF01AMPFO.8.73.G07.1.454.CMB.1.raw
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (480)..(481): a, c, t, g, unknown or other
  misc_feature (480)..(481): n is a, c, g, or t
  modified_base (483)..(491): a, c, t, g, unknown or other
  misc_feature (483)..(491): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgccccccagacctcctcattaatgaataacaacaatccggccctgaggggtctctgaccgattctctgcctccaagtctggcacttctgcctccctggtcatatctggtctccgaggtgaggatggagctgtattattactgccactcctatgacaacngcctgagttagttgctgttcggcggcgggactagtcgaccgtcctacgtcacgccagctcgcccctcggtcactctcgtcccaccctccncgacncgcgacgctgacgcgggctggcaggcgcagtagnncnnnnnnnnn

SEQ ID NO: 149326 - DNA, 493 bp, Homo sapiens
  misc_feature: GYAE6OF01BJUZ3.8.73.G07.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (450)..(450): a, c, t, g, unknown or other
  misc_feature (450)..(450): n is a, c, g, or t
  modified_base (482)..(493): a, c, t, g, unknown or other
  misc_feature (482)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacngcctgagttatttggctggttcggcggcgggaccaagttcgaccgtcctacgtcacgcccaagcctcgcccctcggtccactctcgttccccaccctcctcgaccncgcgagctgacgcggctggcaggcgcgatagnnnnnnnnnnnn

SEQ ID NO: 149327 - DNA, 483 bp, Homo sapiens
  misc_feature: GYAE6OF01B9L9P.8.73.G07.1.454.CMB.1.raw
  modified_base (344)..(344): a, c, t, g, unknown or other
  misc_feature (344)..(344): n is a, c, g, or t
  modified_base (473)..(483): a, c, t, g, unknown or other
  misc_feature (473)..(483): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacngcctgagtatttggctgttcggcggcgggaccaagttgaccgtcctacgtcagcccaaggctcgccccctggtcactctcgttcccaccctcctcgacacgcgagctgagcggctggcaggcgcatagnnnnnnnnnnn

SEQ ID NO: 149328 - DNA, 493 bp, Homo sapiens
  misc_feature: GYAE6OF01C7FD9.8.73.G07.1.454.CMB.1.raw
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (479)..(481): a, c, t, g, unknown or other
  misc_feature (479)..(481): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(493): a, c, t, g, unknown or other
  misc_feature (488)..(493): n is a, c, g, or t
tcagctcgcgtgtccacgaccggtgctcgatttagctctacgctcagggtcctgggcccaggtctgtactgacgcagccgccctcagtatctgggccccagggcagaggtctccatctcctgcactgggagcagaaccagcatcggggcaggttatgatgttcattggtaccgccaggttccaggcacagcccccagactcctcattaatgataacaacaatcggccctcagggtctctgaccgattcntgcctccaagtctggctacttctgccctcctggtcatatctaggtcctacgaggtnaggtatgagctgattatcngccactccatgactacngcctgagtatttggctgttcggcggcggaccaagtcgaccgtcctacgtcacgccaaggctcgcccctcgtcactctcgttccctaccctcctcgacacgcgtactctgtacgtcggcgtggacgacggcgcgatagnnngcncncnnnnnn

SEQ ID NO: 149329 - DNA, 511 bp, Homo sapiens
  misc_feature: GYAE6OF01C0TCV.8.73.G07.1.454.CMB.1.raw
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (500)..(511): a, c, t, g, unknown or other
  misc_feature (500)..(511): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccagggtgaggatgagtctgattattactgccactcctatgacaacagcctgagttatttggcttggttcgggcgggtcgggacctaagttcgaccgttcctacgtcacgcccaaggctccgccccctcggtccactctcgtcccnccctcctccgaccncgcgacgctgaggccgggctgggaccgaggccgcgagtaggnnnnnnnnnnnn

SEQ ID NO: 149330 - DNA, 493 bp, Homo sapiens
  misc_feature: GYAE6OF01EE5L5.8.73.G07.1.454.CMB.1.raw
  modified_base (345)..(345): a, c, t, g, unknown or other
  misc_feature (345)..(345): n is a, c, g, or t
  modified_base (450)..(450): a, c, t, g, unknown or other
  misc_feature (450)..(450): n is a, c, g, or t
  modified_base (483)..(493): a, c, t, g, unknown or other
  misc_feature (483)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgccctccaagtctggcacttctgcctccctggtcatatctggtctccagggtgaggatgaggctgattattactgccactcctatgacaacncgcctgagtatttggctggttccggcgggcgggacctaagttcgaccgtcctacgtcacgcccaagcctcgcccctcgtcactctcgttcccgccctctccgacncgcgagctgagcggcgtggcgaggcgcagtagnnnnnnnnnnn

SEQ ID NO: 149331 - DNA, 492 bp, Homo sapiens
  misc_feature: GYAE6OF01DZYW3.8.73.G07.1.454.CMB.1.raw
  modified_base (304)..(304): a, c, t, g, unknown or other
  misc_feature (304)..(304): n is a, c, g, or t
  modified_base (482)..(492): a, c, t, g, unknown or other
  misc_feature (482)..(492): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtnaggatgaggctgattatactgccactcctatgacaacagcctgagtatttggctgttcggcggcggacaagttcgaccgtctacgtcagcccaaggctcgccccctcggtcactctcttcccaccctctcgacacgcgagctgacgcgggctcggacgaacgggcgcgaacgtagcgnnnnnnnnnnn

SEQ ID NO: 149332 - DNA, 533 bp, Homo sapiens
  misc_feature: GYAE6OF01C0M35.8.73.G07.1.454.CMB.1.raw
  modified_base (523)..(533): a, c, t, g, unknown or other
  misc_feature (523)..(533): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataacaacaactcggccctcgaggggtctctgaccgtattctctgcctccaagtctggctacttctgcccttccctggtcatatctggtctccagggtgaggatgagctgtattagttactgccacttcctatacgacaacagcctagacgttatttggcttgttccgggcggacgggactaaggttcgaccgtcctacgctaacgcccaaggcctccgccccctggtcctactctccgttcccacccttcctcgaccacgtccgacgtcgtagcggcgggctgggaccgaagggccacgagtagctnnnnnnnnnnn

SEQ ID NO: 149333 - DNA, 488 bp, Homo sapiens
  misc_feature: GYAE6OF01EFW5L.8.73.G07.1.454.CMB.1.raw
  modified_base (436)..(436): a, c, t, g, unknown or other
  misc_feature (436)..(436): n is a, c, g, or t
  modified_base (477)..(488): a, c, t, g, unknown or other
  misc_feature (477)..(488): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggaacaactccaacatcggggcaggtcatgatgtacattggtaccagcagtttccaggaaaacgcccccggactcctctatttttgttaacaacgatccgcccctcaggggtccctgaccgcttctctggctccaggtctggcgcctctgccctccctggccatcgctgggctccaccttgacgatggtagggtttttatactgccagtcgtacgacgacagtctgactcgccccggtgttcggcggcgggaccaaggtcgaccgtctgacgtcagcccaaggctcgccccaggtcactctcgtcccncctcctcgacacgcgagctgagcggctggcaggcgcatagnnnnnnnnnnnn

SEQ ID NO: 149334 - DNA, 475 bp, Homo sapiens
  misc_feature: GYAE6OF01COKD8.8.73.G07.1.454.CMB.1.raw
  modified_base (299)..(299): a, c, t, g, unknown or other
  misc_feature (299)..(299): n is a, c, g, or t
  modified_base (432)..(432): a, c, t, g, unknown or other
  misc_feature (432)..(432): n is a, c, g, or t
  modified_base (464)..(475): a, c, t, g, unknown or other
  misc_feature (464)..(475): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcatcggggcaggttatgatgttcattggtaccgccaggttcccaggcacagcccccagactcctcattaatgataacaacaatcggcctcagggtctctgaccgattctctgcctcaagtctggcacttctgcctcctgtcatatctgtctccagggtnaggatgagctgattatactgccactcctatgacaacagtcctgagtatttggcttgttcggcgtcgggacctaagttcgaccgtctacgtcagccaaggctcgcccctgtcactctcgtcccacctctcgacncgcgagctgacgcggctggcgagcacgatagnnnnnnnnnnnn

SEQ ID NO: 149335 - DNA, 480 bp, Homo sapiens
  misc_feature: GYAE6OF01BAVT2.8.73.G07.1.454.CMB.1.raw
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (472)..(480): a, c, t, g, unknown or other
  misc_feature (472)..(480): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacngcctgagtatttggctgttcggnggcgggaccagttgaccgtctacgtcagcccaaggctcgcccctcggtcactctcgttcccnccctcctcgacacgcgagctgagcgggctggcaggcgcntagnnnnnnnnn

SEQ ID NO: 149336 - DNA, 525 bp, Homo sapiens
  misc_feature: GYAE6OF01EW2TD.8.73.G07.1.454.CMB.1.raw
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
  modified_base (515)..(525): a, c, t, g, unknown or other
  misc_feature (515)..(525): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcaatctgtcgtcagggtgaggagtgaggacttgtattattacctacgtcctactcctaactacgaacgaacagacgtagttaggtagtttggtcgtcggttcgggtcggacgggtaccgaacgttcgtaccgtcctacgtccagccacgcctcgcccnccgtctctcctccttccctccctcctccgaccgacgcgacgcgtcgcgcggcgtcggcgacggcgcganagnnnnnnnnnnn

SEQ ID NO: 149337 - DNA, 484 bp, Homo sapiens
  misc_feature: GYAE6OF01AGZ6Y.8.73.G07.1.454.CMB.1.raw
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (472)..(474): a, c, t, g, unknown or other
  misc_feature (472)..(474): n is a, c, g, or t
  modified_base (477)..(484): a, c, t, g, unknown or other
  misc_feature (477)..(484): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcgccctcaggggtctctgaccgattctctgcctccaagtctggcacttctgcctccctggtcatatctgtctccgagggtgaggatgagctgattattactgccactctatgacaacagcctgattattggctggttcggcggcggaccaagttcgaccgtctacgtcagccaggctcgcccctcgcactctcgtcccacctcctcgacncgcgancgtgacgcggctcggcgaacggcgacgagtagnnngcnnnnnnnn

SEQ ID NO: 149338 - DNA, 484 bp, Homo sapiens
  misc_feature: GYAE6OF01DX01Z.8.73.G07.1.454.CMB.1.raw
  modified_base (304)..(304): a, c, t, g, unknown or other
  misc_feature (304)..(304): n is a, c, g, or t
  modified_base (471)..(471): a, c, t, g, unknown or other
  misc_feature (471)..(471): n is a, c, g, or t
  modified_base (475)..(484): a, c, t, g, unknown or other
  misc_feature (475)..(484): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtnaggatgagctgattatactgccactcctatgacaacagcctgagtatttggcttggttcggcggcgggacctaacgtgaccgtctacgtcacgccaaggctcgcccctcggtcactctcgttcccaccctcctcgacacgcgagctgacggcggctggcaggcgcgntagnnnnnnnnnn

SEQ ID NO: 149339 - DNA, 501 bp, Homo sapiens
  misc_feature: GYAE6OF01BVXKJ.8.73.G07.1.454.CMB.1.raw
  modified_base (450)..(450): a, c, t, g, unknown or other
  misc_feature (450)..(450): n is a, c, g, or t
  modified_base (489)..(492): a, c, t, g, unknown or other
  misc_feature (489)..(492): n is a, c, g, or t
  modified_base (495)..(501): a, c, t, g, unknown or other
  misc_feature (495)..(501): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtgaggatgaggctgattattactgccactctatgacaacagcctgatatttggctgttcggcggcgggacctaagttgaccgtcctacgtcacgcccaaggcctcgccccctcggtccacttcctcgttcccacccctcctccgaccnccgcgacgcgtgacgcgggctcgggacaggcgcgatagnnnncgnnnnnnn

SEQ ID NO: 149340 - DNA, 497 bp, Homo sapiens
  misc_feature: GYAE6OF01BYDSE.8.73.G07.1.454.CMB.1.raw
  modified_base (343)..(343): a, c, t, g, unknown or other
  misc_feature (343)..(343): n is a, c, g, or t
  modified_base (487)..(497): a, c, t, g, unknown or other
  misc_feature (487)..(497): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacagcccccagactcctcattaatgataacaacaatcggccctcaggggtctctgaccgattctctgcctccaagtctggcacttctgcctccctggtcatatctggtctccgagggtgaggatgaggctgattattactgccactcctatgacaanagcctgagtatttggcttggttcggcggcgggacctaaggttcgaccgtcctacgtcacgcccaagcctcgcccctcggtcactcctcgttcccaccctcctcgaccacgcgagctgacggcggctggcaaggcgaccagtagnnnnnnnnnnn

SEQ ID NO: 149341 - DNA, 506 bp, Homo sapiens
  misc_feature: GYAE6OF01AGN1M.8.73.G07.1.454.CMB.1.raw
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (494)..(494): a, c, t, g, unknown or other
  misc_feature (494)..(494): n is a, c, g, or t
  modified_base (496)..(506): a, c, t, g, unknown or other
  misc_feature (496)..(506): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctccctggtcatatctggtctccagggtgaggatgaggctgattattactgccactcctatgacaacagcctgagtatttggcttggttcggcgggcgggaccgaagttcgaccgtcctacgtcacgcccaggctcgcccctcggcactctcgttcccnccctcctcgacncgcgacgctcgacggccgggcgtcggcgaacgggcgacgagtagngnnnnnnnnnnn

SEQ ID NO: 149342 - DNA, 628 bp, Homo sapiens
  misc_feature: GYAE6OF01D1XIW.8.73.G07.1.454.CMB.1.raw
  modified_base (337)..(337): a, c, t, g, unknown or other
  misc_feature (337)..(337): n is a, c, g, or t
  modified_base (618)..(618): a, c, t, g, unknown or other
  misc_feature (618)..(618): n is a, c, g, or t
  modified_base (622)..(626): a, c, t, g, unknown or other
  misc_feature (622)..(626): n is a, c, g, or t
tcagctcgcgtgtccacgaccggtgctcgatttagctctacgctcagggtcctgggcccagtctgtactgacgcagccgccctcagtatctggggccccagggcaggagggtctccatctcctgcactgggagcagaaccagcagtcggggcaggttatgatgttcagttggtaccgcaggttccaggcacacgccccagacctcctcattaatgaataaacaacaacgtccggccctcgaggggtctctcggaccgtattctctcgcctaccaagttctggctacttctcgcccttcccgtggtctattacgtcgtcggtctccgagggtcgaggntggacggtctaggtatttatacgcgtacctacttcctaagtacgaaccaacgcgtccgtaggtagtttagttcggtcgttgggtccggcgggtacggtaacctaggttcgtaccgtccgtacgtacgacgacccgtaacggtccctcccgcccccgttcggtacctaccctttccgttcccgttacccctacccgttcctaccggaccgtccggacgtacgtccgtcggacggtccgggtctcgggaccgaaacgggtccgaacgacggttagcgtcgcgncgcnnnnngc

SEQ ID NO: 149343 - DNA, 498 bp, Homo sapiens
  misc_feature: GYAE6OF01EJVV6.8.73.G07.1.454.CMB.1.raw
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (488)..(498): a, c, t, g, unknown or other
  misc_feature (488)..(498): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccgagggtgaggatgagctgattatactgccactctatgacaacagcctgagttattggctgttcggcgggcggactaagttcgaccgtctacgtcacgcccaaggcctcgccccctcgtccactctcgttccccgcccttccnccgaccnccgcgacgcgtgacgcgggcgtggcgacggcgcgagtgnnnnnnnnnnn

SEQ ID NO: 149344 - DNA, 519 bp, Homo sapiens
  misc_feature: GYAE6OF01D85JS.8.73.G07.1.454.CMB.1.raw
  modified_base (349)..(349): a, c, t, g, unknown or other
  misc_feature (349)..(349): n is a, c, g, or t
  modified_base (506)..(507): a, c, t, g, unknown or other
  misc_feature (506)..(507): n is a, c, g, or t
  modified_base (511)..(511): a, c, t, g, unknown or other
  misc_feature (511)..(511): n is a, c, g, or t
  modified_base (513)..(519): a, c, t, g, unknown or other
  misc_feature (513)..(519): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataacaacaatcggccctcaggggtctctgaccgattctctcgcctccaagtctggcacttctcgcctcctggtcatatctggtctccgaggggtgaggatgaggctgtattattactgccactcctatgacaacngcctgatattggctggttcggcggcgggaccgtaagttcgaccgtcctacgtcacgcccgaaggcctcgccccctcggtccacctcctcgttccccaccctcctccgaccacggcgacgcgtgacggccgggcgtcggcaacgggcgacgagttagnngcancnnnnnnn

SEQ ID NO: 149345 - DNA, 512 bp, Homo sapiens
  misc_feature: GYAE6OF01C6ZF6.8.73.G07.1.454.CMB.1.raw
  modified_base (501)..(512): a, c, t, g, unknown or other
  misc_feature (501)..(512): n is a, c, g, or t
tcagctcgcgtgtccacgaccggtgctcgatttagctctacgctcagggtccgtgggcccagtctgtactgacgcagccgccctcagtatctggggccccagggcagagggtctccatctcctgcactgggagcagaaccagcagtcggggctaggttatgtatgttcattggtaccgccaggttccaggcacacgcccccagactcctcattaatgataacaacaatccgccctcgaggggtctctgaccgattctctgcctccaagtctggctacttctgcctccctggtcatatcttggctcgagggtgaggatggaggctagattatactgccactcctatagacaacagcctgacgttatttggcgttggttcgggcggcgggaacctaaggttcgaccgtctacgtcacgcccaaggcctccgcccctcggtcactctcgttccccacctctcacaccgctagctgacgcgggctcggacaggtcgacaagtagnnnnnnnnnnnn

SEQ ID NO: 149346 - DNA, 492 bp, Homo sapiens
  misc_feature: GYAE6OF01A8K9U.8.73.G07.1.454.CMB.1.raw
  modified_base (481)..(492): a, c, t, g, unknown or other
  misc_feature (481)..(492): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctggttcggcggcgggaccaagttgaccgtcctacgtcacgcccaaggctcgccccctcggtccactcctcgttcccgccctcctccgacacgcgagctgagcgggctggcaggcgcatagnnnnnnnnnnnn

SEQ ID NO: 149347 - DNA, 493 bp, Homo sapiens
  misc_feature: GYAE6OF01AJXD1.8.73.G07.1.454.CMB.1.raw
  modified_base (482)..(483): a, c, t, g, unknown or other
  misc_feature (482)..(483): n is a, c, g, or t
  modified_base (485)..(493): a, c, t, g, unknown or other
  misc_feature (485)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccagtgaccgtcctacgtcacgcccaaggctcgccccctggtccactcctcgttcccaccctcctcgacacgcgagctgacgcgggctggcgaacggcgacagtagnncnnnnnnnnn

SEQ ID NO: 149348 - DNA, 602 bp, Homo sapiens
  misc_feature: GYAE6OF01CUVXS.8.73.G07.1.454.CMB.1.raw
  modified_base (362)..(362): a, c, t, g, unknown or other
  misc_feature (362)..(362): n is a, c, g, or t
  modified_base (590)..(590): a, c, t, g, unknown or other
  misc_feature (590)..(590): n is a, c, g, or t
  modified_base (592)..(594): a, c, t, g, unknown or other
  misc_feature (592)..(594): n is a, c, g, or t
  modified_base (596)..(602): a, c, t, g, unknown or other
  misc_feature (596)..(602): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgccctacaagtctggctacttctcgcccttcctggtcatactcgttggtcctccggaggtggaggatggagtctagtattattactgacctactacctatcgaacaacncgtcctaggttagttagttttggacgttggttcgggcgggtaccgggaaccgtaaggttcggaccccgttaccgttacgtcgacgacccgaagggtcctcccgcccccgttcggtacctccttccgtttcccgttaccccctaccccgttcccgtaccgtaaccgacccggtaccgagtccgtagggtaccggccgggtcgtcgggacgaacggtcgacgtagtaggncnnncnnnnnnn

SEQ ID NO: 149349 - DNA, 495 bp, Homo sapiens
  misc_feature: GYAE6OF01BSB2X.8.73.G07.1.454.CMB.1.raw
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (478)..(478): a, c, t, g, unknown or other
  misc_feature (478)..(478): n is a, c, g, or t
  modified_base (486)..(495): a, c, t, g, unknown or other
  misc_feature (486)..(495): n is a, c, g, or t
tcagctcgcgtgtccacgaccggtgctcgattttagctctacgctcgagggtccgtgggcccagtctagtactgacgcagccgccctcagtatctgggccccaggccagaggtctccatctcctgcactgggagcagaaccagcatcgggcaggttatgatgttcattggtaccgccaggttccaggcacagccccccagacctcctcattaatgataaacaacaatcggccctcaggggtctctgaccgattctctgcctccaagtctggcacttctgcctccctggtccatatctggtctccagggtgagggatgagggctgattattactgccactcctatgacaacagcctgatatttggctggttcggcggcgggaccaagttcgaccgtctacgtcagccaagctcgcccctcgtcactctcgttcccnccctcctcgacnccgcgagctgagccgggctgggcaacgggcngactagcnnnnnnnnnn

SEQ ID NO: 149350 - DNA, 512 bp, Homo sapiens
  misc_feature: GYAE6OF01ASSCC.8.73.G07.1.454.CMB.1.raw
  modified_base (328)..(328): a, c, t, g, unknown or other
  misc_feature (328)..(328): n is a, c, g, or t
  modified_base (498)..(498): a, c, t, g, unknown or other
  misc_feature (498)..(498): n is a, c, g, or t
  modified_base (503)..(512): a, c, t, g, unknown or other
  misc_feature (503)..(512): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatggaggctgattattacngccactcctatgacaacagcctgagttatttggcttcggttcgggcggtcggggaccaagttcgaccgtcctacgtcacgcccgaaggcctcgccccctcggtccactcctcgttccccgccccttcctccgactaccggcgtacgctggacgcgggctggcaagggcgnactgnnnnnnnnnn

SEQ ID NO: 149351 - DNA, 549 bp, Homo sapiens
  misc_feature: GYAE6OF01DGPIG.8.73.G07.1.454.CMB.1.raw
  modified_base (333)..(334): a, c, t, g, unknown or other
  misc_feature (333)..(334): n is a, c, g, or t
  modified_base (350)..(350): a, c, t, g, unknown or other
  misc_feature (350)..(350): n is a, c, g, or t
  modified_base (539)..(549): a, c, t, g, unknown or other
  misc_feature (539)..(549): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcatcggggcaggttatgatgttcattggtaccgccaggttccaggcacacgcccccagactcctcattaatgataaacaacaatccggccctcgaggggtctctgaccgtattctctcgcctccaagtctcggctacttctcgcctcctggtcatactcgtgtcctcgagggtgagatgagtctgtattatcnncctactctatgacacngctgtagtattggctggttcggcggtacggactaagtcgtaccgtcgtacgtcacgacccgaaggcctacccgccccttcggtcctaccttccgttcccgtacccctaccccttccgtaccgaccgaccggaccgtacggccgttggacgggtccgggtcgtacggaccgaacgggcacgtacgtagcnnnnnnnnnnn

SEQ ID NO: 149352 - DNA, 691 bp, Homo sapiens
  misc_feature: GYAE6OF01CD7RL.8.73.G07.1.454.CMB.1.raw
  modified_base (279)..(279): a, c, t, g, unknown or other
  misc_feature (279)..(279): n is a, c, g, or t
  modified_base (684)..(684): a, c, t, g, unknown or other
  misc_feature (684)..(684): n is a, c, g, or t
tcagctcgcgtgtccacgaccggtgctcgatttagctctacgctcagggtccgtgggcccagtctgtactgacgcagccgccctcagtatctggggccccagggcagagggtctccatctcctgcactgggagcagaaccagcatcggggcaggttatgatgttcattcggtaccgccaggttccaggcacagcccccagactcctcattaatgataacaacaatcggccctcgaggggtctctgaccgtattctctgcctccaagtcctggcacttcngccctcctgtcatatcgtggtctccgagggtgacggtatcggagtctaggtatttactttactggtccctacttcccgtaattcggaacctaacgacggtaccctggtaacgtagttttcgggcttcggttccgggccgggtaccggggtaacctaacgggtttcgaccccggtaccgtttaccggtacgtaaccggaccccgtaaaggtacccttcggacccccccgttacggtccctaaccttcccgtttccgttaccccccgacccgttcccgtaccggacccgaccggtaccggtacggtacccgttacggaaccggtcccggggtacgtccggggtaccgtaaacggggtcccggtacggtaacgttaacggcgaacgcgactacgtacgcgtagcgtcncgtaccg

SEQ ID NO: 149353 - DNA, 531 bp, Homo sapiens
  misc_feature: GYAE6OF01CEVS8.8.73.G07.1.454.CMB.1.raw
  modified_base (255)..(255): a, c, t, g, unknown or other
  misc_feature (255)..(255): n is a, c, g, or t
  modified_base (520)..(531): a, c, t, g, unknown or other
  misc_feature (520)..(531): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccccagacctcctcatttaatgaataaacaacaatccggccctcgaggggtctctgaccgnttctctgccctcaagtctggcacttctgccttccctggtcatatctggtctccagggtcgaggatgaggctgattatactgccactcctatcgacaacagcctagacgtattttggcttggttcgggcgggcgggacctaaggttcgaccgtccttacgtcacgcccaaggcctccgccccctcggtcctacctcctcgtcccgccctcctaccgaccgaccgcgagcgtcggacggccggcgtcggacgacgcgactagtaggnnnnnnnnnnnn

SEQ ID NO: 149354 - DNA, 654 bp, Homo sapiens
  misc_feature: GYAE6OF01CUQ62.8.73.G07.1.454.CMB.1.raw
  modified_base (312)..(312): a, c, t, g, unknown or other
  misc_feature (312)..(312): n is a, c, g, or t
  modified_base (631)..(631): a, c, t, g, unknown or other
  misc_feature (631)..(631): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (647)..(648): a, c, t, g, unknown or other
  misc_feature (647)..(648): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaatgataacaacaatcggcctcgaggggtctctgaccgatttctctcgcctaccaagtctggcacttctcgcctcctggtcatatctggtctcgaggtgaggtntggagtctagtattacttactgaccctacttcctaatgaacctaacgacgccgttagtacgtttacgttttcgggacgtttgggttaccgggcgggtaccggggtaaccctaaaggtttccggaccccgttaccgttaacggtccgaaccggaccccgtaaagggtcccttcccggtcccccgttcgggtacctaaccgttccgtttcccgtttcccccgccctttcgtaccgaccgtaccggtcgaacggtccgttacgggaccgggtcggggtaccgtcggggaacccgaaacggggccgtaccgtaaagttagggntccggancncgtcacnncngngn

SEQ ID NO: 149355 - DNA, 498 bp, Homo sapiens
  misc_feature: GYAE6OF01CRFMV.8.73.G07.1.454.CMB.1.raw
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (488)..(498): a, c, t, g, unknown or other
  misc_feature (488)..(498): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattcctctgccctccaagtctggcacttctgcctccctggtcattatctggtctccgaggtgaggatgagctgattattacngccactctatgacaacngcctgagttatttggctggttcggcggcgggacctaagttcgtaccgtcctacgtcacgcccaacggctcgccccctcgtccactctcgttcccaccctcctcgacncgcgngctgaggcggctggcgaacggcgcgagtagnnnnnnnnnnn

SEQ ID NO: 149356 - DNA, 517 bp, Homo sapiens
  misc_feature: GYAE6OF01AC10Y.8.73.G07.1.454.CMB.1.raw
  modified_base (507)..(517): a, c, t, g, unknown or other
  misc_feature (507)..(517): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccagggtgaggatgagctgattagttactcgccactcctatgacaacagcctgtagtattttggcttgtttcggcgggtaccgggaccgtaagttcggtacccgtccgtacgtcacgcccgaaggctccgcccccgtcgtcctactcctcgttccccgccctcctccgaccaccgcgacgctcgcgcgggctggcacggcgcgatagcnnnnnnnnnnn

SEQ ID NO: 149357 - DNA, 532 bp, Homo sapiens
  misc_feature: GYAE6OF01ACOBF.8.73.G07.1.454.CMB.1.raw
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(532): a, c, t, g, unknown or other
  misc_feature (525)..(532): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgtattctctgcctccaagtctggcacttctgcctccctggtcatatctggtctccgagggtnaggntgagctgattattacngccactcctatgacaacngcctgagttatttggctggttcggcggacgggacctagttcgaccgtcctacgtcacgcccaaggtcctacgcccccgtcggtccacccttcgtcccgttccccaccccttcctccgaccacgccgtagccgttgacggccgggctcggacgtaacggccgtacgagttacggncnncnnnnnnnn

SEQ ID NO: 149358 - DNA, 586 bp, Homo sapiens
  misc_feature: GYAE6OF01CJHW2.8.73.G07.1.454.CMB.1.raw
  modified_base (343)..(343): a, c, t, g, unknown or other
  misc_feature (343)..(343): n is a, c, g, or t
  modified_base (548)..(548): a, c, t, g, unknown or other
  misc_feature (548)..(548): n is a, c, g, or t
  modified_base (575)..(586): a, c, t, g, unknown or other
  misc_feature (575)..(586): n is a, c, g, or t
tcagctcgcgtgtccacgaccggtgctcgatttagctctacgctcagggtcctgggcccagtctgtactgacgcagccgccctcagtatctggggccccagggcaggagggtctccatctcctgcactgggagcagaaccagcagtcggggcaggttatgatgttcattggtaccgccaggttccaggcacacgcccccagacctcctcaattaatgaataaacaacaatccggccctcgaggggtctctgaccgtattctctgccctccaagtctggctacttctcgcctccctggtcatatcgtcggtctcgagggtgaggatgaggctgtattattacgngacctactccgtaatcgaaaccaacgaacgtccgtagaagtttatttcgggcgttggttccgggcgggacggaacgtaacggttcgacccgtcctacgtacgacgaccgaacggctccgcccccgtcggtcctaccttccgttccggttccccgtcccctccgtacccgaaccgccggaccgtacgccgtaggacgggcccgggngtcggacgaaagggccgacgtataggnnnnnnnnnnnn

SEQ ID NO: 149359 - DNA, 519 bp, Homo sapiens
  misc_feature: GYAE6OF01EHSKW.8.73.G07.1.454.CMB.1.raw
  modified_base (351)..(351): a, c, t, g, unknown or other
  misc_feature (351)..(351): n is a, c, g, or t
  modified_base (507)..(511): a, c, t, g, unknown or other
  misc_feature (507)..(511): n is a, c, g, or t
  modified_base (513)..(519): a, c, t, g, unknown or other
  misc_feature (513)..(519): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggtaggttatgatgttcattggtaccgccaggttccaggcacagcccccagactcctcattaatgataacaacaatcggccctcaggggtctctgaccgtattctctgcctccaagttctggcacttctcgccctccctggtcatatctggtctccgagggtgaggatgaggctgattattactgcccactcctatgaacaacngcctagagttatttcggcttggttcgggcggacgggacctaagttcgaccgtcctacgtcacgccgaggtctccgcccctcggtccactcctcgttccccaccctcctcgaccacgcgagtcgtgacggtcggcgtcggacgaacggcgacagtgnnnnncnnnnnnn

SEQ ID NO: 149360 - DNA, 760 bp, Homo sapiens
  misc_feature: GYAE6OF01DE968.8.73.G07.1.454.CMB.1.raw
  modified_base (732)..(732): a, c, t, g, unknown or other
  misc_feature (732)..(732): n is a, c, g, or t
  modified_base (739)..(739): a, c, t, g, unknown or other
  misc_feature (739)..(739): n is a, c, g, or t
  modified_base (749)..(760): a, c, t, g, unknown or other
  misc_feature (749)..(760): n is a, c, g, or t
tcagctcgcgtgtccacgaccggtgctcgatttagctctacgctcagggtcctgggcccagtctgtactgacgcagccgccctcagtatctgggccccagggcagagggtctcatctcctgcacgtgggagcacgaaccagcaggtcggggctaggttatgtattgttctagttcggtacccgccgtacggttccgacggccacgaccgcccccagtacctcctactaattaatacaaactaaaccaaactaacgtccggtcccgtacggtacggggttcctcgtacgaaccgttcttccttcgtcgtacccctaccgtaaagttccgtggaccttcctttccgtccgtccccttcccgtggtactaattcttcgtcggttcctaccggtagggttggaaggtagtagggtacgggtaccttaggttaattttacgttaaccgtccggtaccctaaccttaccgtaagtacggaaaccaaacgtcgtacccgttaggtaaacgttttgtttcgggtacgtttcgggttccggggccggggtaaccggtacgttaaacggttccgaccccgttaccgttacgtccgaaccgacccgtaacggtccctccccgtcccccgttacggtcccttacccgttcccgttccccggttccccgtcccccttccgtaccgaacccgcccggtaccggtaacgtccggttggaaccgggcccgggttcgtccgggaacggngggaccncgaaagtggnnnnnnnnnnnn

SEQ ID NO: 149361 - DNA, 504 bp, Homo sapiens
  misc_feature: GYAE6OF01DY6G1.8.73.G07.1.454.CMB.1.raw
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (495)..(504): a, c, t, g, unknown or other
  misc_feature (495)..(504): n is a, c, g, or t
tcagctcgcgtgtccacgaccggtgctcgatttagctctacgctcagggtcctgggcccagtctgtactgacgcagccgccctcagtatctggggccccagggcagagggtctccatcgggggggggtcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccgagggtgaggatgaggctgatttatctgccactcctatgacaacagcctgtagtattttggcttggttcggcgggcgggacctaagttcgaccgtctacgtcacgcccaaggcctcgcccctcggtcactctcgtcccnccctcncgacncgcgacgctgaggcgggctcgggcaacggcgcgatagnnnnnnnnnn

SEQ ID NO: 149362 - DNA, 586 bp, Homo sapiens
  misc_feature: GYAE6OF01DWQ6M.8.73.G07.1.454.CMB.1.raw
  modified_base (566)..(566): a, c, t, g, unknown or other
  misc_feature (566)..(566): n is a, c, g, or t
  modified_base (575)..(586): a, c, t, g, unknown or other
  misc_feature (575)..(586): n is a, c, g, or t
tcagctcgcgtgtccacgaccggtgctcgatttagctctacgctcagggtcctgggcccagtctgtactgacgcagccgccctcagtatctgggggccccaggggcaggagggtctccatctcctgcactggggagcagaaccagcagtcggggcaggttatgatgttcagttggtaccgccaggttccaggcacacgcccccagactcctcattaatgaactaaacaacaatccggccctcgaggggtctctgaccgtattctctgcctccaagtctggcacttctcgcctccctggtcatctctggtctccggagggtcgaggtatggagcgttagtaatttattaccgtgccctaacgttacctatacgaaactaaacgcgtccgttaggtaaggtttatttcgggtcttcgggtttcgggacgggtacgggtacctaaggttcgacccgttacctacgtcacgacccgagctccgcccctggtcctacttcctccgttccccaccctccgtacgaccgacggcgacggtctagggacggtcgggactcgggcgtacgggccncgaagtcgnnnnnnnnnnnn

SEQ ID NO: 149363 - DNA, 638 bp, Homo sapiens
  misc_feature: GYAE6OF01DENUQ.8.73.G07.1.454.CMB.1.raw
  modified_base (568)..(568): a, c, t, g, unknown or other
  misc_feature (568)..(568): n is a, c, g, or t
  modified_base (627)..(627): a, c, t, g, unknown or other
  misc_feature (627)..(627): n is a, c, g, or t
  modified_base (629)..(638): a, c, t, g, unknown or other
  misc_feature (629)..(638): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactggggagcagaaccagcagtcggggcaggttatgatgttcagttggtaccgccaggttccaggcacacgcccccagacctcctcaattaatgaataaacaacaactccggcctcgaggggtctcgtcgaccgtattctctcgcctacaagtctggctacttctcgccttccgtggtactatactcgtcggttcctcggagggtgaggtatcggaagtcgtagttattaacgttactcgacctaacctcctaaagtacgaactaacgcgtaccgtaggtagtttacgtttcggtacgtcgggttaccgggcgggtaccgggtaaccgtaaggttccggtacccgtacgttaccgtacgaaccggacccgacggtaccgtcccggtccccgtcggtccctaccgttccgttcccgttaccccgtccccgtccgtaccgaaccnccggtacgaccgttcgacggcggccgggtcgtcgggaccgaaccggcgacgaagtaggncnnnnnnnnnn

SEQ ID NO: 149364 - DNA, 647 bp, Homo sapiens
  misc_feature: GYAE6OF01ATGCU.8.73.G07.1.454.CMB.1.raw
  modified_base (635)..(638): a, c, t, g, unknown or other
  misc_feature (635)..(638): n is a, c, g, or t
  modified_base (640)..(644): a, c, t, g, unknown or other
  misc_feature (640)..(644): n is a, c, g, or t
  modified_base (646)..(647): a, c, t, g, unknown or other
  misc_feature (646)..(647): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcagttggtacccgccgaggttccaggcacacgcccccagactcctcattaatagaataaacaacagtccgccctgacgggtctcgtcgaccgtattctctcgaccctaccgtaacggttctcggaccttaccttccgtccgtccccttcccgttggtacctacttacgttcgttcggtccgtaccggtaggggtggaggtacgtggaagtctgttaacttacgttactcgacctactacctaagacgaacaacgtcgtacgtgtagtttagtggtcgttcgggtaccgggcgggtaccggtaacgtacggttaccgtaccgttacccgtacgaccgtaccgacccgtacggtcccgtccccggtccccgttcgtccctacgttcccgttccgtcccctacccgtcgtccgaccgccggacgtcgtccgtagggaccggcgggtacgcggacgacggccgtacgacgtgacnnnngnnnnngnn

SEQ ID NO: 149365 - DNA, 590 bp, Homo sapiens
  misc_feature: GYAE6OF01DEFR1.8.73.G07.1.454.CMB.1.raw
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (580)..(590): a, c, t, g, unknown or other
  misc_feature (580)..(590): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcgaggggtctcgtgaccgtattctctcgcctaccaagtctggctacttctgtccctcctggtctattatctggtctccgagggtgaggatggagtctgtattatactgccactctatcgacaacnctcctagacgttnttttcggcgttcggtttcgggaccgggtcgggaacccgtaaggttccgtaacccgttccgtacggtaccacggtccccgaaaggccctacccggtccccccgttcggtccctacctttcctcccggttccccctcccccgtcctccggaaccaccggccgacgtcgtcggacgggccgggacggtcggaccgaacgggtcgacgtagtagnnnnnnnnnnn

SEQ ID NO: 149366 - DNA, 691 bp, Homo sapiens
  misc_feature: GYAE6OF01BEYM2.8.73.G07.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatccggccctcgaggggtctctgaccgattctctgcctccaagtctggcacttcngcctcctggtctatatctggtctccgagggtgaggntgaggctgtattattactgcctacttcctatcggaacaacacgtcctagagttacgtttggcgttgggttccgggccgggtaccgggtaacctaagggttccgtaacccggttcccgttaacggtacccgacggtaccccgaagggtccctacccggtccccccgtttacgggtccctaacccgttcccgtttacccgtttaccccccctaacccccgttccccgttaacccggaacccgtaccccgggaccggtaaccggttccggttaccgggaaccggggtcccgggggtacccgttacgggggaacccggaaacggggtccccggtaacgtaaacggttaggacttccggcgtacgcgtacgacgngcgngngcg

SEQ ID NO: 149367 - DNA, 699 bp, Homo sapiens
  misc_feature: GYAE6OF01C2JBQ.8.73.G07.1.454.CMB.1.raw
  modified_base (132)..(132): a, c, t, g, unknown or other
  misc_feature (132)..(132): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
  modified_base (683)..(685): a, c, t, g, unknown or other
  misc_feature (683)..(685): n is a, c, g, or t
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
  modified_base (694)..(695): a, c, t, g, unknown or other
  misc_feature (694)..(695): n is a, c, g, or t
  modified_base (697)..(699): a, c, t, g, unknown or other
  misc_feature (697)..(699): n is a, c, g, or t
tcagctcgcgtgtccacgaccggtgctcgatttagctctacgctcagggtcctgggcccagtctgtactgacacagccgccctcagtatctggggccccagggcagagggtctccatctcctgcactgggancagaaccagcatcggggcaggttatgatgttcattggtaccgcaggttccaggcacacgcccccagacctcctacattaaatgaataacaactaactcggccctgacggggttctctgaccgtnttctctcgcctccaagtctggcctacttcncgcccttcctggtccattactcgtcggtctccgaggggtgaagggtntcggaggtctagtactttactacctgccctacgtccttacgtacgaaccaacgacggcctagtagttacgtttcggcgtttcgggttccgggcgggtaccggggtaaccgtaaaggtttcccggtaacccggttaccttacccggtaccgtaccgggtacccgtaaacggggtcccttccccgggaccccccgtttaccgggtcccgttaaccctttcccgtttcccggtttacccccccgaccccttcccccggtaccggtaacccgacccgggtccgtaaccgggtccgtacgggacgggtcccgggacgtacgggtaccgaaccgggtaccgcgtaacgttagggcnnncncgtcncnncnnn

SEQ ID NO: 149368 - DNA, 879 bp, Homo sapiens
  misc_feature: GYAE6OF01CR7WJ.8.73.G07.1.454.CMB.1.raw
  modified_base (851)..(851): a, c, t, g, unknown or other
  misc_feature (851)..(851): n is a, c, g, or t
  modified_base (855)..(855): a, c, t, g, unknown or other
  misc_feature (855)..(855): n is a, c, g, or t
  modified_base (870)..(870): a, c, t, g, unknown or other
  misc_feature (870)..(870): n is a, c, g, or t
  modified_base (876)..(876): a, c, t, g, unknown or other
  misc_feature (876)..(876): n is a, c, g, or t
  modified_base (878)..(878): a, c, t, g, unknown or other
  misc_feature (878)..(878): n is a, c, g, or t
tcagctcgcgtgtccacgaccggtgctcgatttagctctacgctcagggtcctgggcccagtctgtactgacgcagccgccctcagtatctggggccccagggcagagggtctccatcctcctgcactgggagcagaaccagcagtcggggcaggttatgatgttcattggtaccgcaggttccaggcacacgcccccagactcctctaattaatgaataaacaacaacgtccggccctacgagggtctcgtcgaccgtattcctcgtgtccctaccgtaaggttctggtacctacctttcctcgtccccttcccgtggtacctacttacgttccgttacggtccgtaccggtaggggtacggtaaggtacgtaggacggttacgttaagttactttaacgtttaaccgtcggtaacccctaccgttaccgttaacgtaaccggaaacctaaccgtaacggttaccccgttaaggttaaaccggtttttaggttttacgggtccggttttcggggtttaccccgggggtaaccgggggtacccggggtaaacccgtttaaaccgggttttccggtaaacccccggtttacccggtttaaccggacccgaacccggtaacccgggtaaaccggttcccgtttaccccccggtaccccccggtttaccgggtaccccttacccgtttcccgttttacccccgggtttaccccccctaccccccgtttaccggtacccgaacccggttaacccgggacccgggttaccggtccggttaggggtaccccgggggtgggtaacccgggtaccggaaacccgggtacgggtaccccgtaagtaaacccggttagggntacncgtacgacgtcacgngcgtgngng

SEQ ID NO: 149369 - DNA, 554 bp, Homo sapiens
  misc_feature: GYAE6OF01ARFIW.8.73.G07.1.454.CMB.1.raw
  modified_base (360)..(360): a, c, t, g, unknown or other
  misc_feature (360)..(360): n is a, c, g, or t
  modified_base (542)..(542): a, c, t, g, unknown or other
  misc_feature (542)..(542): n is a, c, g, or t
  modified_base (545)..(546): a, c, t, g, unknown or other
  misc_feature (545)..(546): n is a, c, g, or t
  modified_base (548)..(548): a, c, t, g, unknown or other
  misc_feature (548)..(548): n is a, c, g, or t
  modified_base (550)..(554): a, c, t, g, unknown or other
  misc_feature (550)..(554): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccccagacctcctcattaatgaataacaacaatccggccctcgaggggtctctgaccgtattctctgcctccaagtctggcacttctcgcctccctggtcattatcgtggtcctccgaggggtgaggatggaggctgtatttatactcgccactcctatgacaacngcctgagttattggctggttcggcgggacggacaagttcgaccgtctgcgtcacgcccgaaggcctccgtcccccgtcggtcctacctccgttccgttcccccgccgttccctccggacccgacggtccggacgtcgtacgggacggtccgggcgtacgggccaacgggcggacagtacggnagnntncnnnnn

SEQ ID NO: 149370 - DNA, 634 bp, Homo sapiens
  misc_feature: GYAE6OF01BD263.8.73.G07.1.454.CMB.1.raw
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (629)..(634): a, c, t, g, unknown or other
  misc_feature (629)..(634): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatccggccctcgacggggtctctgaccgtattctctgcctccaagtcctggcacttctcgcctccctggtcatactctcggtctccgagggtgaggatggaggtctagtattattactcgccacttcctatacgaaccaacagtccgtagtagtttagtttgggcgtttcgggttccgggcggggtaccgggtaaccgtacgggtttaccgaacccgttaccgtaccgtacgaccggtaccccgaaacgggtcctacccggtcccccgttcggtacctaccgttccgttacccgttccccctaccctttcccgaccgtaacccgaccggtccggtacgtccgtacgggacgggtccggggtaccgtcgggaccgtaacgggcccgtacgacgtaggctgacngcncnnnnnn

SEQ ID NO: 149371 - DNA, 506 bp, Homo sapiens
  misc_feature: GYAE6OF01DNBJA.8.73.G07.1.454.CMB.1.raw
  modified_base (360)..(360): a, c, t, g, unknown or other
  misc_feature (360)..(360): n is a, c, g, or t
  modified_base (490)..(490): a, c, t, g, unknown or other
  misc_feature (490)..(490): n is a, c, g, or t
  modified_base (497)..(506): a, c, t, g, unknown or other
  misc_feature (497)..(506): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgccctccaagtctggcacttctgccctcctggtcatatctggtctccgagggtgaggatgaggtctgtattattactgccactcctatgaacaacagcctgtagtntttggcttggttcggcgggcgggactagttcgaccgtcctacgtcacgacccaaggcctccgcccctcggtcctacttctcgttccccgccctcctcgaccacgcgagctgacggcggcgtggcgaggcncgagtgnnnnnnnnnn

SEQ ID NO: 149372 - DNA, 605 bp, Homo sapiens
  misc_feature: GYAE6OF01CCLN5.8.73.G07.1.454.CMB.1.raw
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
  modified_base (578)..(578): a, c, t, g, unknown or other
  misc_feature (578)..(578): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
tcagctcgcgtgtccacgaccggtgctcgatttagctctacgctcagggtcctgggcccagtctgtactgacgcagccgccctcagtatctggggccccgagggcagagggtctccatctcctgcactggagcagaccagcatcgggcagttatgatgttcattggtaccgcaggttccaggcacacgccccagactcctacattaatgataacaacaatcggcctcaggggtctactgaccgattcctctcgcctaccaagtctggacacttctcgaccctccgtggtaccatacttcgtggtccgtcgagggtgaggtatcggaggtctaggtattagttacctgaccctagtacctatcgaacaactacgctagtagtagttggctaggttcggacggaccgggactacggttagacccggtacttaacgcacgtacccgaacgtcnccgtcccgtcgtacncctctacccgtcccctacccctcgtccgtaaccgacggcggtaagtccggaggtaccgggtcggggtaccccgttaagggaccggtaaacggccggtacgaacgggttaaccngcgacgacgacgtacactanctgcgng

SEQ ID NO: 149373 - DNA, 487 bp, Homo sapiens
  misc_feature: GYAE6OF01E5ZBV.8.73.G07.1.454.CMB.1.raw
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (476)..(487): a, c, t, g, unknown or other
  misc_feature (476)..(487): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccgagggtgaggatgaggctgattattactgccactcctatgacaacngcctgagttattggctggtcggcggcgggacagtcgaccgtctacgtcacgccaagctcgcccctcgtcactcctcgttccccnccctctccgacncgcgagcgtgacgcggcncggcaggcgngagtgnnnnnnnnnnnn

SEQ ID NO: 149374 - DNA, 550 bp, Homo sapiens
  misc_feature: GYAE6OF01EZFQO.8.73.G07.1.454.CMB.1.raw
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(550): a, c, t, g, unknown or other
  misc_feature (545)..(550): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcgccctcgagggtctctgacgattctctgccctcaagtctggctacttctcgcctccctggtcatatcgtggtctccgagggtgaggatggagctgtatttatactgcctactactatacgacaacgtcgctgagttatttggctggttcggcggcgggtacctaagttccgacccgttcctaccgtcgaacgtacccgaaggcctccgtcccccgtcgtcctaccttctccgtcccctacctccctccgacgaccggcgacgcgtcggtaggccgggtcgtcgggaccgtaaacgggccgtacgacgtagagcgcgncncnnnnnn

SEQ ID NO: 149375 - DNA, 693 bp, Homo sapiens
  misc_feature: GYAE6OF01ENDSU.8.73.G07.1.454.CMB.1.raw
  modified_base (679)..(679): a, c, t, g, unknown or other
  misc_feature (679)..(679): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (690)..(691): a, c, t, g, unknown or other
  misc_feature (690)..(691): n is a, c, g, or t
  modified_base (693)..(693): a, c, t, g, unknown or other
  misc_feature (693)..(693): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataaacaacaactccggccctcgtacggggtctctgaccgtattccgtctcgcctacctaacgttcgtggactaccttctcgcccttcccgtggtctatactcgttggtcctccggaggggtcgaggagtggaggtcgttagtaacttttacgttaccgtcgtacctaccttacctaagtaccgaaacgaacctacggtccgttaaggtagtttacggtttcgggtccgtttcgggttccggggtaccgggaacccggggtacttaaaggtttcccggaacccgttccgtaaccggtccgaaccggtacccgaagggtccctaccccggtccccgttggtaccctacccgttcgtttacccgtccccccgtccctaccgttccgacccgacggccggtacgttccggtagaccggggtccggtactacggggacctaacggggcctaccggagttaggctcggntcgncnancgnngn

SEQ ID NO: 149376 - DNA, 662 bp, Homo sapiens
  misc_feature: GYAE6OF01BALAK.8.73.G07.1.454.CMB.1.raw
  modified_base (374)..(374): a, c, t, g, unknown or other
  misc_feature (374)..(374): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (656)..(662): a, c, t, g, unknown or other
  misc_feature (656)..(662): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgataacaacaatccggccctcaggggtctctgaccgtattctctgcctccaagtcctggctacttctcgccctcccgtggtccattatccgtggttcctccggagggtgaggatggaggctagtattattactcgtcctactccgtaatcgtaaccaaacncgtccttggacgtttagtttcgggcttcgggtttcggggaccgggtaccggggtaaccgtaacgggtttaccgacccggttccgttaccgtaccgaaccgaccccgtaaacggtcccgtacccgtccccccgttccgggttccctacccgttcccttccccgtttacccccacccccttcccgttacccggaaccgtaccggcccggtaacggtccgtacggacgggtccggggtccgtacgggaccgaaacgggccgacgtaacggtacgngacngacncnnnnnnn

SEQ ID NO: 149377 - DNA, 501 bp, Homo sapiens
  misc_feature: GYAE6OF01BAIR0.8.73.G07.1.454.CMB.1.raw
  modified_base (452)..(452): a, c, t, g, unknown or other
  misc_feature (452)..(452): n is a, c, g, or t
  modified_base (484)..(501): a, c, t, g, unknown or other
  misc_feature (484)..(501): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgtacattggtaccagcagtttccaggaaaagcccccggactcctctatttttgtaacaacgatcgcccctcaggggtccctgacccgcttctctggctccgaggtctggcgcctctcgcctccctggccatcgctgggcctccacctttgacgtatgtagggtttttatactgcctagtcgtacgacgacagtctgactcgccccggtgttcggcggcggaccaggtcgactgtcctgagtcacgcccaggcctcgcccccaggtcactctcgttccccgccctcctcgacncgcgagctgagcgggctggcaaggcacatagnnnnnnnnnnnnnnnnnn

SEQ ID NO: 149378 - DNA, 498 bp, Homo sapiens
  misc_feature: GYAE6OF01ETP0F.8.73.G07.1.454.CMB.1.raw
  modified_base (301)..(301): a, c, t, g, unknown or other
  misc_feature (301)..(301): n is a, c, g, or t
  modified_base (469)..(469): a, c, t, g, unknown or other
  misc_feature (469)..(469): n is a, c, g, or t
  modified_base (487)..(490): a, c, t, g, unknown or other
  misc_feature (487)..(490): n is a, c, g, or t
  modified_base (493)..(498): a, c, t, g, unknown or other
  misc_feature (493)..(498): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcagggtctctgaccgattctctgcctccaagtctggcacttctgcctccctggtctatatctggtctccngggttgaggatggagctgatttattactgccactcctatcgacaacagcctgagttatttggctgttcggcggcgggactaagttcgaccgtctacgtcacgccaaggcctcgccccctcgtcactctcgttccccacctcctccacacgcgacgctgacgcggtcgnggcgaacggcacgatagnnnngcnnnnnn

SEQ ID NO: 149379 - DNA, 625 bp, Homo sapiens
  misc_feature: GYAE6OF01DEQ9T.8.73.G07.1.454.CMB.1.raw
  modified_base (272)..(272): a, c, t, g, unknown or other
  misc_feature (272)..(272): n is a, c, g, or t
  modified_base (611)..(611): a, c, t, g, unknown or other
  misc_feature (611)..(611): n is a, c, g, or t
  modified_base (615)..(616): a, c, t, g, unknown or other
  misc_feature (615)..(616): n is a, c, g, or t
  modified_base (619)..(625): a, c, t, g, unknown or other
  misc_feature (619)..(625): n is a, c, g, or t
tcagctcgcgtgtccacgaccggtgctcgatttagctctacgctcagggtcctgggcccagtctgtactgacgcagcccgccctcagtatcgtggggccccagggcaggagggtctccatctcctgcacgtgggagcagaaccagcagtcggggctaggttatgattgttcattcggtaccgccgaggttccaggccacacgcccccagacctcctactaattaatgaataaacaactaacgtccggccctcgaggggtctcgtgaaccgtnttcctctcgccctacgtacgtcgtggctaccttctcgtccctccgtggtccattctcgtcggtcctcggtagggtggaggactggagtcgtagttaattactacgtctaccctacttacctagtacgaaccaacgcgtccgtagttaggtttagtttcgggtacgttcgggtcgggccgggtacgggacctaacggttccggtaccgtccgtaacgtcgaacgccgaacgcgtcccgtcccgtcgtcctacctcgttcccgtcccgtccctccgtaccgaccgcgacggtacgtcgacggcgggacggtcgtagggaccgacgggtcgaacgtgtagcncganncgnnnnnnn

SEQ ID NO: 149380 - DNA, 519 bp, Homo sapiens
  misc_feature: GYAE6OF01EXBB8.8.73.G07.1.454.CMB.1.raw
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (509)..(519): a, c, t, g, unknown or other
  misc_feature (509)..(519): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatccggccctcgaggggtctcgtgaccgtattctctgcctccaagtctggctacttcngcctccgtgtcatatctggtctccgagggtgaggntggagctgatttatactcgcctactcctatcgaacaacgcgtcctaggtagtttagtttggcttggttccgggcgggaccgggtactaaggttcgaccgtcctacgtcacgccgagtcctcgccccgtcgtccacttcgtccgttccccgcctccncgacncgcgacgcgngcgcggcnggacgaggcncgatgnnnnnnnnnnn

SEQ ID NO: 149381 - DNA, 767 bp, Homo sapiens
  misc_feature: GYAE6OF01D0SJ8.8.73.G07.1.454.CMB.1.raw
  modified_base (136)..(136): a, c, t, g, unknown or other
  misc_feature (136)..(136): n is a, c, g, or t
  modified_base (744)..(744): a, c, t, g, unknown or other
  misc_feature (744)..(744): n is a, c, g, or t
  modified_base (752)..(752): a, c, t, g, unknown or other
  misc_feature (752)..(752): n is a, c, g, or t
  modified_base (759)..(759): a, c, t, g, unknown or other
  misc_feature (759)..(759): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
tcagctcgcgtgtccacgaccggtgctcgatttagctctacgctcagggtcctgggcccagtctgtactgacgcagccgccctcagtatcgtcggggccccagggcaggagggtctccatctcctgcactggggancagaaccagcagtcggggcaggttatgatgttcagttggtaccgcgtaggttccaggcacacgcccccagacctcctactaattaatagaactaaaacaaacctaaacgttcccggcccgttacggacgggggttcctaccgtacgaaccggttattccttccgtacgtccctaccgtaacggttctacggacctaccgtttcctcggtccccttccccgtaggttaccaatttacgtcgttcgggtacgttaccggagggttagaggtagtggagggtctagtaatttaatcgtagtaccctacttacctaagtacgaaacaacgacgtccttaggtatacgttttggacgttcgggttaccgggaccggtaccgggtaaccgttaacgggttaccggtaccccgttacccgtacggtacccgaaccggtaacccggtaacgtcccgttcccggtcccccgtacggttccctacccgtttaccgttcccccggtttcccccttcccgtaaccggaacccgtacccggtaccggtaccggtacgttacggggaccggttacgggggtccgtacgggtacggtaacgggaccgtaagtaaccgtaggancgcgacgncgtcganagcngnga

SEQ ID NO: 149382 - DNA, 533 bp, Homo sapiens
  misc_feature: GYAE6OF01DNSO1.8.73.G07.1.454.CMB.1.raw
  modified_base (317)..(317): a, c, t, g, unknown or other
  misc_feature (317)..(317): n is a, c, g, or t
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
  modified_base (520)..(521): a, c, t, g, unknown or other
  misc_feature (520)..(521): n is a, c, g, or t
  modified_base (529)..(533): a, c, t, g, unknown or other
  misc_feature (529)..(533): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgccccccagactcctcaattaatgaataaacaaacaactccggccctcgaggggtctcgtgaccgtattctctgccctaccagtctggctacttctgcctcctggtcatatctgtcctcgaggtnaggatgaggctgtatttaatctgcctacgtcctaatacgaacaacgcgcctagtagtttatttcgggnttcggttacggcgggaccggtacgtaagtcgacccgtcgtacgtcacgtaccgaagtccnccgccctgctactctcgtaccnccctcncgactcgcganctggacgcggtcgnggagaccggcgagtaactagcnncatgcagnnnnn

SEQ ID NO: 149383 - DNA, 729 bp, Homo sapiens
  misc_feature: GYAE6OF01EEDG1.8.73.G07.1.454.CMB.1.raw
  modified_base (320)..(320): a, c, t, g, unknown or other
  misc_feature (320)..(320): n is a, c, g, or t
  modified_base (703)..(703): a, c, t, g, unknown or other
  misc_feature (703)..(703): n is a, c, g, or t
  modified_base (719)..(719): a, c, t, g, unknown or other
  misc_feature (719)..(719): n is a, c, g, or t
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgattgttcattggtaccgccaggttccaggcacacgcccccagacctcctacattaatgaataacaaacaatccggccctcgaggggtctctgaccgtattctctgcctaccaagtctggctacttctcgcctcctgtctatatctggtctccgagggtgagntgaggtctgtattactacgtcgacctactcctatacgtaaccaacgtagtacctaggtaagtttagttttcgggccgtttgggtttacccgggggaccgggtacccgggggtaaacccgtaaacgggtttccggtaaccccggtttcccgttaaacccgggttacccaacccgggaaccccgtaaacgggtccccgtttaccccgggtacccccccggttccgggttaccccttacccgtttaccccgtttcccggtttaccccccctaaccccggtttccccgttaaccggacccggtaccggaccgttaccggttacgggaaccgggtccggggcccgttacggggaccgtaaacgggggtccctaacgtacgttaacggnacgtcgacgcgcgtcncgngcngngn

SEQ ID NO: 149384 - DNA, 514 bp, Homo sapiens
  misc_feature: GYAE6OF01A434A.8.73.G07.1.454.CMB.1.raw
  modified_base (501)..(501): a, c, t, g, unknown or other
  misc_feature (501)..(501): n is a, c, g, or t
  modified_base (504)..(506): a, c, t, g, unknown or other
  misc_feature (504)..(506): n is a, c, g, or t
  modified_base (508)..(514): a, c, t, g, unknown or other
  misc_feature (508)..(514): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcatcggggcaggttatgatgttcattggtaccgccaggttccaggcacagccccagactcctcattaatgatacaacaatcggccctcaggggtctctgaccgattctctgcctccaagtctggctacttctcgcctccctggtccatatctggtctccgagggtgaggatcgaggctgacttagtactgccactcctatgacaacgagcctgagttattggcttgtcggtcgacgggacctaagttcggaccgtcccgtagtcgtacgaccaaggcctcgtaccccctcggtccactccgttacgttcccacccctcctcgaccacggcagctgacgcggctaggcaaggcgcgatacgntcnnncnnnnnnn

SEQ ID NO: 149385 - DNA, 744 bp, Homo sapiens
  misc_feature: GYAE6OF01EXOWC.8.73.G07.1.454.CMB.1.raw
  modified_base (727)..(727): a, c, t, g, unknown or other
  misc_feature (727)..(727): n is a, c, g, or t
  modified_base (739)..(739): a, c, t, g, unknown or other
  misc_feature (739)..(739): n is a, c, g, or t
  modified_base (741)..(744): a, c, t, g, unknown or other
  misc_feature (741)..(744): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgaataaacaacaatccggccctcgaggggtctctgaccgattctctgcctccaagtctggctaccttctcgcccttcccctgggtacctatactccgttcggttcctacccgtaggggtacggaggacgttaggacggtcgttaggtattttaacgttaaccgtcgtaccctaaccttacccttaagtacggaaaccaacgtaacgtcccgttaggtaagttttacgtttcgggtacgtttcgggtttccggggaccggggtacggggtaacccgtaacggtttacggaccccggtttacccgttaacccgggttaccgaaccggtacccgtaaacggtaccccgttcccggtacccccccggtttcgggtaccctacccgttacccgtttcccggtttacccccctaccccgttccccgttcccgaaccggacccgtacgggaccgttaccgttacgggaacgggccggggtccgttcggggaccgtaaacggggcccgacggtaagttaaggntacgcgagcacnannnn

SEQ ID NO: 149386 - DNA, 604 bp, Homo sapiens
  misc_feature: GYAE6OF01DW01S.8.73.G07.1.454.CMB.1.raw
  modified_base (270)..(270): a, c, t, g, unknown or other
  misc_feature (270)..(270): n is a, c, g, or t
  modified_base (529)..(529): a, c, t, g, unknown or other
  misc_feature (529)..(529): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
  modified_base (589)..(589): a, c, t, g, unknown or other
  misc_feature (589)..(589): n is a, c, g, or t
  modified_base (594)..(595): a, c, t, g, unknown or other
  misc_feature (594)..(595): n is a, c, g, or t
  modified_base (597)..(604): a, c, t, g, unknown or other
  misc_feature (597)..(604): n is a, c, g, or t
tcagctcgcgtgtccacgaccggtgctcgatttagctctacgctcagggtcctgggcccagtctgtactgacgcagccgccctcagtatcgtggggccccagggcaggagggtctccatctcctgcactgggagcagaaccagcagtcggggcaggttatgatgttcattggtaccgccaggttccaggcacaccgccccagacctcctacattaatgaataaacaaacaacgtccggccctagacggggttctcgtagaccgtattccnctcgccctacaagtctcggcctacttctcgccctccgtgtctatacgtcgtcggtcctccggaggtacgaggtagtcggaggtcttaggtaactttacttaccgtacgtcctaaccttaccgttatacggaacctaacgcgtacgttagtacgtttagttcggtcgtggtccgggcggacggactacgtccgccgttctacgtaccacgaccgaggtccctcccgtacccgtggtaccctcgttccgttccccgtcccncccttcacggacnccggtcgacgtgaccgggnggtccggcgtggaccagggccaactagngactnngnnnnnnnn

SEQ ID NO: 149387 - DNA, 681 bp, Homo sapiens
  misc_feature: GYAE6OF01CKEXG.8.73.G07.1.454.CMB.1.raw
  modified_base (669)..(671): a, c, t, g, unknown or other
  misc_feature (669)..(671): n is a, c, g, or t
  modified_base (673)..(678): a, c, t, g, unknown or other
  misc_feature (673)..(678): n is a, c, g, or t
  modified_base (680)..(681): a, c, t, g, unknown or other
  misc_feature (680)..(681): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcagtcggggctaggttatgtattgttctagtttcggtacccgccgtaggttccagggccaccacgccccccaagacctcctcaattaatagaataaacaaactaacgtccggcccctacgtaggggtcctctcgaccgtacttctctagccctaccaaggtcctggcctacttctcgcccttcccgtgtctattacgtctggtcctccggaggtgaggtatggaggtctagtaatttaagttacgtcgacctactaccttagtacgaaccaacgtacgtacctggtaagtttcgttttggacgtttgggttccggggcgggtaccgggtaccgttaacggttaccggacccgtttaccgtaccgtaccgacgcccgtaacggcccgtccgcccccgtcggtccctaccgtttcctacccgttaccccctcccgttaccgtaccgtacccgaccggacgtacgtccggtacggtcggcgggtaccggtcgggaaccggaacgggtcccggtaaacgtacggtcggagnnngnnnnnngnn

SEQ ID NO: 149388 - DNA, 581 bp, Homo sapiens
  misc_feature: GYAE6OF01ECR3D.8.73.G07.1.454.CMB.1.raw
  modified_base (511)..(511): a, c, t, g, unknown or other
  misc_feature (511)..(511): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (574)..(581): a, c, t, g, unknown or other
  misc_feature (574)..(581): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcatcggggcaggttatgatgttcattggtaccgccaggttccaggcacacgcccccagactcctcattaatgataacaacaatccggccctcgaggggtcctctgaccgattctctgcctccaagtctggcacttctgcctcctggtcatatctggtctccgaggggtgaggatggaggctagtatttattactcgcctactcctatgaacaacagtccttagagttagtttcggcgttcggttcgggcggtccgggacctaaggtttcggacccgttccgttaccgtacacgacccgtaacggtcctacccggcccccgttccggtacctacccttccgtcgttcccccgcccttcccgtccggaacccnccggcggactccggtgacgggccggtcgtcgggacgaccgggcgaccgtagtagngcgnacgnnnnnnnn

SEQ ID NO: 149389 - DNA, 631 bp, Homo sapiens
  misc_feature: GYAE6OF01D0N0X.8.73.G07.1.454.CMB.1.raw
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
  modified_base (626)..(629): a, c, t, g, unknown or other
  misc_feature (626)..(629): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataaacaacaactccggccctacgaggggtcctctcgaccgattctctcgccctaccaagtctaggctacttctgccctcctggtctatatctggtctccgtagggtgaggatggagtctagtattactactcgcctactccgtaatcgaacaacacgtctgtagttagtttggcgttcgggttccgggcgggtaccggggaacctaaggttacggacccgttacctaaccggtcgaacgcccgtaaacggccgtacccggccccccgttaccgggtaccctaccgttcctttacccgttacccccctaccccgttaccccgttaccgaaccgaacccgtccggacgttcgtacggcgggtaccgggcgtagggaccgaacggggtccgacgtacgtagtcngagcagnannnngc

SEQ ID NO: 149390 - DNA, 490 bp, Homo sapiens
  misc_feature: GYAE6OF01BW0WK.8.73.G07.1.454.CMB.1.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
  modified_base (479)..(490): a, c, t, g, unknown or other
  misc_feature (479)..(490): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataaacaacaatcggccctcaggggtctctgaccgattctctgcctccaagtctggcacttctgcctccctggtcatatctggtctccaggtnaggatgaggctgattattactgccactccatgacaacagcctgagtatttggctgttcggcggtcgggacaagttnaccgtcctacgtcagcccaaggctgcccctggtcactctgttcccacctcctcgacacgcgagactgacgcgggcctggccgaaaggcgaccgatagnnnnnnnnnnnn

SEQ ID NO: 149391 - DNA, 606 bp, Homo sapiens
  misc_feature: GYAE6OF01DKYPL.8.73.G07.1.454.CMB.1.raw
  modified_base (211)..(211): a, c, t, g, unknown or other
  misc_feature (211)..(211): n is a, c, g, or t
  modified_base (361)..(361): a, c, t, g, unknown or other
  misc_feature (361)..(361): n is a, c, g, or t
  modified_base (595)..(606): a, c, t, g, unknown or other
  misc_feature (595)..(606): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaangataacaacaactccggccctcgaggggtctctgaccgtattctctcgcctccaagtctggctacgttctgccctccctggtccatatctggtctccgagggtgaggatggaggtctagatttatacgtgacctactctatacgaccaancgcctagtaacgtgttttgggcctttgggttcccgggacgggtaccggggtaacccgtaaggttcgtaccccgttaccgtaccggttacccgacgtaccccgaaacgggtcccttccggccccccgtttccggtctacccgttccgttccgttccccccgtcccctcccggtccgaccgaccgccgagccgtcgacgggtcgggcggtcggaccgaaggtccgacgtatacggnnnnnnnnnnnn

SEQ ID NO: 149392 - DNA, 720 bp, Homo sapiens
  misc_feature: GYAE6OF01DKUQ7.8.73.G07.1.454.CMB.1.raw
  modified_base (710)..(720): a, c, t, g, unknown or other
  misc_feature (710)..(720): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcagtcgggggcaggttatgatgttcagttggtaccgcctaggttccaggcacacgcccccagactcctcattaatagaactaaaccaacaagtccggccctcgtacggggtctcgtcgacccgtattccgctcgcctaccgaagtcgtggcctacctttctcgtccccttccgtaggtcctattacgttccgttcggtccgttccggaggggtaggaagggtagtacgggaggtaccttaggttaactttaactttaccggtctaccccgtaccttacctaagtaccgaaactaaccgtacgtaacccgtttaggtaacgtttagttttcgggccgttttcggggtttaccggggcccggggtaaccggggtaacccggtaacggttccggtaccccggttaccgtaccgttaccgaccgaaccccgtaacggtcccgtccccgtacccccggttccggtccgtacccgttccgtttcccggttcccccgccctttcccgacccgtaccgaccggccggcgtccgtggaccgggtcgggccgttaggaccgagggcccgagtacgtagcnnnnnnnnnnn

SEQ ID NO: 149393 - DNA, 813 bp, Homo sapiens
  misc_feature: GYAE6OF01DOONA.8.73.G07.1.454.CMB.1.raw
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
tcagctcgcgtgtccacgaccggtgctcgatttagctctacgctcagggtcctgggcccagtctgtactgacgcagccgccctcagtatctggggccccagggcagagggtctccatcctcctgcacgtgggagcagaaccagcagtcggggcaggttatgattgttcagttcggtaccgcctacggttccaggcacaccgcccccagtacctcctactaattaatcgaaactaaaccgaactaacgtccggtacccgtacggtacggggttcctacgtacgtaccgtactttccgtcttccgaccctacgtaacgtccgtcggaccttacctttccgtcgtccccttcccggttacggtactaacgttacttccggttggttcccgttaaccgggtagggtaggaccgggtattaccgggagggttaccttaggttaactttaccttacgtacgtaccgttaaccttaccgtaagttacgaacctaaccgtacgtccgttagttacggtttcgtttaccggtcgtttcgggttaccggggccgggttaaccggtacgtttacggtacccggtacccggttaccgttacggtacccgtaaccggtacccgtaaccgggtcccgttacccggtcccccggttaccgttaccctacccgtttcccgttacccccgtttacccctaccccgttacccgtacccgtaacccggtccgtacgggtaccgttacggtacgggtaccgggtcggacgggttaccgcgggaaccgtccggtacgttaacgcgacttcgcgtacctgcctggcctgngngtc

SEQ ID NO: 149394 - DNA, 678 bp, Homo sapiens
  misc_feature: GYAE6OF01E33BQ.8.73.G07.1.454.CMB.1.raw
  modified_base (325)..(326): a, c, t, g, unknown or other
  misc_feature (325)..(326): n is a, c, g, or t
  modified_base (329)..(329): a, c, t, g, unknown or other
  misc_feature (329)..(329): n is a, c, g, or t
  modified_base (344)..(345): a, c, t, g, unknown or other
  misc_feature (344)..(345): n is a, c, g, or t
  modified_base (662)..(662): a, c, t, g, unknown or other
  misc_feature (662)..(662): n is a, c, g, or t
  modified_base (671)..(672): a, c, t, g, unknown or other
  misc_feature (671)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacacgcccccagacctcctcattaatgaataaacaacaatccggccctcgaggggtctctgaccgattctctgccctcctaagtctggcctacttctcgtccctccctggtcatactcgtgtctacgagggtgaggnnggngtctgtattattacnncctactctatcgaacaacacgtcctgtagttagtttcggtacttgggttccgggcgggtacccgggtaaccgtacggttaccgtaccccgttacccgtacgtccgaccggacccgaacggtcccgtaccccgtcccccgttaccggtccctacccgttcccgttcccgtttacccccccaccccgttacccgtacccggtaaacccgtaccccggggaaccgtaacccgggttacgggacccggggttacccgggggtcccggtacggggaacccggtaaccgggggacccgttacccaacggttacgcgagtccgntacgctcgnncngngc

SEQ ID NO: 149395 - DNA, 755 bp, Homo sapiens
  misc_feature: GYAE6OF01C9KOG.8.73.G07.1.454.CMB.1.raw
  modified_base (134)..(134): a, c, t, g, unknown or other
  misc_feature (134)..(134): n is a, c, g, or t
  modified_base (744)..(744): a, c, t, g, unknown or other
  misc_feature (744)..(744): n is a, c, g, or t
  modified_base (746)..(755): a, c, t, g, unknown or other
  misc_feature (746)..(755): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcacgtgggagnagaaccagcagtcggggcaggttatgatgttcagttcggtaccgccgtacggttccgaggccaaccgaccgaccccccacgaccttccctactaatttaaatgaaactaaaccaaacaacgttccggcccgtacgacggggttcctcgtacggtaccgtatttccgtctcggaccctacccgtaagtcgttcggactccgttctccgtccctccgtggtacattactcgtcgttcctaccggagggttgaggtagttggaggtcttagtaactttacgttacgtcgaccgtagtaccaagttagacgacgacgtaccgtacgttccggtttggttttccggggtttttggggttggtttacgggggaaccgggtaacggggtaaacccgtaggtaccgttacccgggttaaccccgttcgggttcggtccggttaccgaaccggaacccggtaccggttcccgtaccccccggttccccgttcggtaacccctttacccgtttccgttaccccggtacccccttacccccgtaccgtacccgaacccgttaccgcggacgtaccggtcggacgggccggttcccgagggaccggacgggtccagtacggngnnnnnnnnnn

SEQ ID NO: 149396 - DNA, 702 bp, Homo sapiens
  misc_feature: GYAE6OF01AI779.8.73.G07.1.454.CMB.1.raw
  modified_base (176)..(176): a, c, t, g, unknown or other
  misc_feature (176)..(176): n is a, c, g, or t
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
  modified_base (689)..(690): a, c, t, g, unknown or other
  misc_feature (689)..(690): n is a, c, g, or t
  modified_base (693)..(694): a, c, t, g, unknown or other
  misc_feature (693)..(694): n is a, c, g, or t
  modified_base (698)..(698): a, c, t, g, unknown or other
  misc_feature (698)..(698): n is a, c, g, or t
  modified_base (701)..(702): a, c, t, g, unknown or other
  misc_feature (701)..(702): n is a, c, g, or t
tcagctcgcgtgtccacgaccggtgctcgatttagctctacgctcagggtcctgggcccagtctgtactgacgcagccgccctcagtatctggggccccagggcaggacgggtctccatctcctgcactggagcagaaccagcagtcggggcaggttatgatgttcattggtaccnccaggttccaggcacacgccccccagacttcctcatttaagcgaataaccaacaactcggccctgaggggtcctcgtcgaccgtattcctctcgccctccgtaagtctcggctacctttcgtcgcccttcccgtaggtactagttacgtcgttcggtcctaccgaggggtagacggtatcggacggtctagttactttaacgtttaaccgcgacctacgttaccgttataccgaactaaccgaggtccgttaaggtaaggtttacggttttcgggacggtttcgggttacccggggacgggtaaccggggtaaccctttaagggttccccggtaacccgttccggtacgtacccgggttaccaccgggaccccgtaacgggtccctccccgggtccccggttaacgtctaaccgtttccttcccgtaaccccctccgttacgcccgacgccggtcgaccgtcgtcgggacggccggtcgccggaacggacggtccgaccgttanacggnacgnngcnngacngtnn

SEQ ID NO: 149397 - DNA, 584 bp, Homo sapiens
  misc_feature: GYAE6OF01EWZEI.8.73.G07.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgtattctctgcctccaagtctggcacttctgccttcctggtcattanctggtctccgaggtgaggntgagctgtatttatacgtcgccacgtcctagtcgaacaacngtacctgtagttacgtttggcttggttccggcggtcgggaacctaaggttcgtaccgttcctaacgtcaacgcccgaaggtcctccgtcccctcggtccaccgttccgttccgttacccccacccgtccctacccgtaacgacccgtcggtacgtccgtcggacggtccgggtacgtcggaccgtaacgggccgactacggttagcgngtcganacgtcgagancgngngn

SEQ ID NO: 149398 - DNA, 602 bp, Homo sapiens
  misc_feature: GYAE6OF01B8QTL.8.73.G07.1.454.CMB.1.raw
  modified_base (273)..(273): a, c, t, g, unknown or other
  misc_feature (273)..(273): n is a, c, g, or t
  modified_base (583)..(584): a, c, t, g, unknown or other
  misc_feature (583)..(584): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagctcgcgtgtccacgaccggtgctcgatttagctctacgctcagggtcctgggcccagtctgtactgacgcagccaccctcagtatctggggccccagggcagagggtctccatctcctgcactgggagcagaaccagcagtcgggcaggttatgatgttcattggtaccgccaggttccaggcacagcccccagactcctcattaatgataacaacaatcggccctcgagggtctctgaccgattctctgcctcaagtctggcacttcncgcctcctgtcatatctggtctccgagggtgaggatgagtctgatttattacgtcgccacttcctaatcgaaccaacacgtccttgagttacgtttcggcttcggtttcgggcgggaccgggtaccgtaaggtttcggacccgttaccgtacgtccgaacggtaccccgaaaggtcctccgtccccccgttcggtccctaccgtttccttcccggtttcccccgtccccttacccgttccgaccacccggtacgacgtcctagggaccggcgggtacctcgggaccgaacgggccgaccgacgttacganncagtcgctcgancngngc

SEQ ID NO: 149399 - DNA, 779 bp, Homo sapiens
  misc_feature: GYAE6OF01DJWHO.8.73.G07.1.454.CMB.1.raw
  modified_base (134)..(134): a, c, t, g, unknown or other
  misc_feature (134)..(134): n is a, c, g, or t
  modified_base (760)..(760): a, c, t, g, unknown or other
  misc_feature (760)..(760): n is a, c, g, or t
tcagctcgcgtgtccacgaccggtgctcgatttagctctacgctcagggtccgtgggcccagtctgtactgacgcagccgccctcagtatctcggggccccagggcagagggtctccatctcctgcactgggancagaaccagcagtcggggcaggttatgatgttcattggtaccgccaggttccaggcaccacgcccccagtacctccctcattaatgaactaaacaaccaatccggcccctcgacgggggttctcgtaggaccgtatttcctctcgccctcctaacgtcttgggcctaccttctcgccccttcccgtggtcctacttacgtttccgtggttcctccggaggggtaggagggtattggacgggtcttacggtatttaactttaccgtcgccctactttcctagtacgaacctaaccgacgtcccgtagtaaggttacgttttcggcgtttgggtcccggggtccggtaccgggggtaacccgtaaggtttcccgacccggtttacccgtaccgtaccgacggacccgtaacggtccccgttacccggtcccccgttacccgggttccctaacccgttttcccgtttacccgtttacccccccgtacccccctttacccgtcccgtaacccgtaacccggggtaccgtacgggtacccggttacgggtacccgggggacccggggttccggttacccggggaccggaaacccggggtccgtaaccgggtaaccgtagggctacgccggngacgtcacgtgctcgcgcg

SEQ ID NO: 149400 - DNA, 822 bp, Homo sapiens
  misc_feature: GYAE6OF01A41N1.8.73.G07.1.454.CMB.1.raw
  modified_base (695)..(695): a, c, t, g, unknown or other
  misc_feature (695)..(695): n is a, c, g, or t
  modified_base (798)..(798): a, c, t, g, unknown or other
  misc_feature (798)..(798): n is a, c, g, or t
  modified_base (802)..(802): a, c, t, g, unknown or other
  misc_feature (802)..(802): n is a, c, g, or t
  modified_base (808)..(808): a, c, t, g, unknown or other
  misc_feature (808)..(808): n is a, c, g, or t
  modified_base (812)..(812): a, c, t, g, unknown or other
  misc_feature (812)..(812): n is a, c, g, or t
  modified_base (814)..(814): a, c, t, g, unknown or other
  misc_feature (814)..(814): n is a, c, g, or t
  modified_base (817)..(817): a, c, t, g, unknown or other
  misc_feature (817)..(817): n is a, c, g, or t
  modified_base (820)..(820): a, c, t, g, unknown or other
  misc_feature (820)..(820): n is a, c, g, or t
  modified_base (822)..(822): a, c, t, g, unknown or other
  misc_feature (822)..(822): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcacgtgggagcagaaccagcagtcgggcaggttatgatgttctagttcggtacccgccgtacggttccgaggccaccgaccgcccccagtacctcctactaattatagaactaaacaaactacgtccggccctcggacgggttctcgtaccgaccgtacttcctaccgtcgtcccgtacttaacggttccgtggacctttaccttctccggtcccttcccgtaggtacctattacgtccggttcgttaccgtaccgggtaggggttggaaggtagtcggacggtcttaggttaactttttacgtaccgtaccgtacccttaacgtttacgttaaatcggaaaccctaaacggtccgtacgttaggttacgtttacggttggttaccggtttcggggtaccggggacccggggtaacgggtttaacccgttaagggttcccccgtaacccggtttacccgtaacgggtacccgaacccggtaccccgggttaaacgtccccccgggttacccccgtcccccggttttccggtaaacccgtttccccgttccgtttaccccccggttacccccncccccgttttacggacccgtaccggtacccgggaccgtagggttccggacgggccggtaacgggtccggaaggtacccggtaaccggcgttaaagccgggtancggncgtcgngacngntcncgngn

SEQ ID NO: 149401 - DNA, 631 bp, Homo sapiens
  misc_feature: GYAE6OF01EDAXM.8.73.G07.1.454.CMB.1.raw
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (628)..(629): a, c, t, g, unknown or other
  misc_feature (628)..(629): n is a, c, g, or t
  modified_base (631)..(631): a, c, t, g, unknown or other
  misc_feature (631)..(631): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccgaggttccaggcacacgccccagacctcctcattaatgaataacaacaatccggccctcgtacggggtcctctgaccgtattctctgccctccaagtctggctacttctcgcctcctggtctatatcgtggtcctccgagggtgaggtgtggaggtctgtatttacttacncgcctactcctatacgaacaacngccgtagtacgtttagtttcggcgttgggtcgggaccgggtacgggtaaccgtaggttccggaacccgttccgtaccggtaccgaccgacccgaacggtcccttacccggtcccccgttccggtcctaccgtttcccgttcccgttccccctaccccttcccgtaccgaccgtacccggaccgtacgtccgttcggaccgggtccgggcgtaccggggacgaccggtcggacgtaacggtagcgtnacngngcangcnngn

SEQ ID NO: 149402 - DNA, 650 bp, Homo sapiens
  misc_feature: GYAE6OF01CFDNJ.8.73.G07.1.454.CMB.1.raw
  modified_base (164)..(164): a, c, t, g, unknown or other
  misc_feature (164)..(164): n is a, c, g, or t
  modified_base (268)..(268): a, c, t, g, unknown or other
  misc_feature (268)..(268): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (633)..(633): a, c, t, g, unknown or other
  misc_feature (633)..(633): n is a, c, g, or t
  modified_base (641)..(641): a, c, t, g, unknown or other
  misc_feature (641)..(641): n is a, c, g, or t
  modified_base (644)..(645): a, c, t, g, unknown or other
  misc_feature (644)..(645): n is a, c, g, or t
  modified_base (647)..(647): a, c, t, g, unknown or other
  misc_feature (647)..(647): n is a, c, g, or t
  modified_base (649)..(650): a, c, t, g, unknown or other
  misc_feature (649)..(650): n is a, c, g, or t
tcagctcgcgtgtccacgaccggtgctcgatttagctctacgctcagggtcctgggcccagtctgtactgacgcagcccgccctcagtatcgtcggggcccccagggcaggagggtctccatctcctgcactgggagcacgaaccagcagtcggggcaggttangatgtcatggtaccgccaggttccaggcacacgcccccagtacctcctacaattaatgaataaacaacaacgtccggccctcgaggggtcctcgtagaaccgtnttctctcgcctaccgaagtctacggcctacttcctcggtcccttcccttaggtacagttacgtcgttacggcccttcggagggtnaggacgtgaggtctagtactacgttacncgaccttactactatacgaacaacgtacgacgtagtagtttagtttcgggcttagggtccggacgggtacggtaaacccgtaggtttaccggacccgttaccttaaaccggcgtaaccgaacccgacggtctcccgtccccgtgtaccacttccgttacccgttaccacccgtccgtacgaccgtccggaccgagtacgtccggacggggtcggcccgagggacctacggggcaaacggttcgtacaggtcnctagagtnacnncngnn

SEQ ID NO: 149403 - DNA, 850 bp, Homo sapiens
  misc_feature: GYAE6OF01DTI3E.8.73.G07.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
  modified_base (845)..(845): a, c, t, g, unknown or other
  misc_feature (845)..(845): n is a, c, g, or t
  modified_base (847)..(847): a, c, t, g, unknown or other
  misc_feature (847)..(847): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttctagttggtaccgcgaggttccaggcacaccgccccagctcctcattaanagaactaaacaacaacgtccgcctcgacgggttctctacggacgtcttctctcgccctacctaagtcctggcctacttctcgtccctaccgtgtcattatcgtcgttcctcgagggtgaggtgtgaggtcagtttatacgttacncgtacctacttaccgtatacgaactaacgacgtaccgttaggtaacgtttcgtttacgggtccgtttcggggttacccggggtacccgggggtaacccgggtaacccggttaacggtttaccccgggtaaccccggttttaccccggtaaccgggtttacccgaaaccccgggtaacccggtaaacgggttccccccgttccccggggttaaccccccccgttttcggggttaaccccccttttacccggtttaccccggttttaccccccggttttaacccccccccgttacccccgggtttaaccccgttacccccgggtaaacccccggtacccggggtaacccgggtttacccggtacccgggttaacgggggtcccggggtaccggggttaacccgggtaacccggggttaaccgggaaccggggttaacccggacccgttaaagggttacccggactccgcgtcgacgtcgtactagtcngngcg

SEQ ID NO: 149404 - DNA, 655 bp, Homo sapiens
  misc_feature: GYAE6OF01CFM2F.8.73.G07.1.454.CMB.1.raw
  modified_base (633)..(633): a, c, t, g, unknown or other
  misc_feature (633)..(633): n is a, c, g, or t
  modified_base (637)..(655): a, c, t, g, unknown or other
  misc_feature (637)..(655): n is a, c, g, or t
tcagctcgcgtgtccacgaccggtgctcgatttagctctacgctcagggtcctgggcccagtctgtactgacgcagccgccctcagtatctggggcccccagggcaggagggtctccatctcctgcactgggaacaactccaacagtcggggcaggtcatgatgtactattggtaccagctagttccaaggaaaacgcccccggactcctctattttgtaacaacgactccgccctcgacggggtccctcggaccgtcttctcgtcgcctccgaggtcgtcggccgtcctctcgccctccgtcggccacgtccgcgtcggcctaccgtaccgttggacgtagttaggttacggtttttactcgtcgtaccgtagtaccgtacggacgacgtacgtcgtacgaccgttccggtacccggttggttccgggcgggaccggtaacgaacgggttccggacccgttcgtacggacgtaccggtacccggaccgtaaccgggcccgttaccccggacccccggtaaccgggttcccctaacccttcccgttcccgttaccccccgtacccttccgtaccgaccgaccgacgaccgtcggacgggtcggccgggcgtacgggacgacggcgtaacgtgnacgnnnnnnnnnnnnnnnnnnn

SEQ ID NO: 149405 - DNA, 879 bp, Homo sapiens
  misc_feature: GYAE6OF01EQLRM.8.73.G07.1.454.CMB.1.raw
  modified_base (133)..(133): a, c, t, g, unknown or other
  misc_feature (133)..(133): n is a, c, g, or t
  modified_base (142)..(142): a, c, t, g, unknown or other
  misc_feature (142)..(142): n is a, c, g, or t
  modified_base (258)..(258): a, c, t, g, unknown or other
  misc_feature (258)..(258): n is a, c, g, or t
  modified_base (817)..(817): a, c, t, g, unknown or other
  misc_feature (817)..(817): n is a, c, g, or t
  modified_base (825)..(825): a, c, t, g, unknown or other
  misc_feature (825)..(825): n is a, c, g, or t
  modified_base (832)..(832): a, c, t, g, unknown or other
  misc_feature (832)..(832): n is a, c, g, or t
  modified_base (840)..(840): a, c, t, g, unknown or other
  misc_feature (840)..(840): n is a, c, g, or t
  modified_base (847)..(848): a, c, t, g, unknown or other
  misc_feature (847)..(848): n is a, c, g, or t
  modified_base (867)..(867): a, c, t, g, unknown or other
  misc_feature (867)..(867): n is a, c, g, or t
tcagctcgcgtgtccacgaccggtgctcgatttagctctacgctcagggtcctgggcccagtctgtactgacgcagccctccctccgcgtccgggtctcctggacagtcagtcaccatctcctgcactggacnccagcagtnattacaactatactctcctacggtaaccaacaaccacccgaggaccaaaccgacccctaaactcattgttacgttttaggacgtacaacgtacgccggtacctcggacgggttccngtacgtccgttccttcgcgtacggtcctacgtaacggttcgacgacccgtaaccgccggttccctccgtacgtcccgttcgtcgtacggtacctaccgtaggtaccgtaggaaggtcgttacgggacggtccgttaacggtttactttaccggtttacacggtaccgtaaccgttccttaagtacgttacggtacccggaacgggttactaaaccgggtaactaaacccggggggtttagggttaccggtaaccgggggtaaccggggaaacccggtttaaaccggtttaccgggttaaccccggtaacccgggtttacccgtaccgggtaacccgtaaccccggggacccggttaaacccggtccggtttaacccccgttccccggttacccggttaacccgttccccgggttaaccccgtttaacccggtaccccccgttacccggttacccccgtttacggaaccccgttcccggtaaaccggttcggtaccgggtacggtacccggggccggtttacggaaccgggtacgtacggtccccgaagtacccgtgggntaccgggnttaacgngtcgttancgtaccnncggtcaagggtcctatacncggttcaacggg

SEQ ID NO: 149406 - DNA, 551 bp, Homo sapiens
  misc_feature: GYAE6OF01A54JI.8.73.G07.1.454.CMB.1.raw
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
  modified_base (473)..(473): a, c, t, g, unknown or other
  misc_feature (473)..(473): n is a, c, g, or t
  modified_base (541)..(543): a, c, t, g, unknown or other
  misc_feature (541)..(543): n is a, c, g, or t
  modified_base (545)..(551): a, c, t, g, unknown or other
  misc_feature (545)..(551): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataacaacaatccggccctgagggtctctgaccgattctctgccctccgaagttctggctacctttcncgtccttcccgtggtcattactctggtcctccgagggtgaggatggaggtctgtatttacttacgtcncctacttccttatcgaaccaacgacgtccgtagtagttatttggcgttggtcggcgggcggacgtagttcgaccgtctacgtcacgccagcctccgacccctcgtctacgtcttccgtaccccnccctcctacacgaccgcgacgtcgtacggcggtcgggtcgtggaccgtagggcccgacgtagcgtcgnnncnnnnnnn

SEQ ID NO: 149407 - DNA, 709 bp, Homo sapiens
  misc_feature: GYAE6OF01ANTRR.8.73.G07.1.454.CMB.1.raw
  modified_base (221)..(221): a, c, t, g, unknown or other
  misc_feature (221)..(221): n is a, c, g, or t
  modified_base (683)..(683): a, c, t, g, unknown or other
  misc_feature (683)..(683): n is a, c, g, or t
  modified_base (699)..(699): a, c, t, g, unknown or other
  misc_feature (699)..(699): n is a, c, g, or t
  modified_base (703)..(703): a, c, t, g, unknown or other
  misc_feature (703)..(703): n is a, c, g, or t
  modified_base (707)..(707): a, c, t, g, unknown or other
  misc_feature (707)..(707): n is a, c, g, or t
tcagctcgcgtgtccacgaccggtgctcgatttagctctacgctcagggtcctgggcccagtctgtactgacgcagccgccctcagtatctggggccccagggcaggagggtctccatctcctgcactgggagcagaaccagcagtcggggctaggttatggattgttcagttcggtaccgcctaggttccaggcacacgcccccagacctcctcattaangactaacaacacgtcggccctgagggtctctagaccgtattctctcgccctccaagttctggcctactttcgtcgcccttccgtggtcattacgtcgttcggtcctaccggtaggggtcgaggtactagggacggtcttaggtacttttacgtttaccgtcgacccttacttacccttatacgaaccaacgtacgccgtagtacggtttagtttcgggcgtttcgggtccggggacggtacccgggtaacgtaacggttaccggtaccgttaccgttaccggttccgaccgtacccggaacggttccctacccggtcccccgttcgggtaccctaccgttcccgttcccggttaccccctccccgttacccgtacccggaccgtaccggtaccgggtaccgtaccgtcggtacgggccgggtaaccgttccgggaccgtacgggtccgacggtacgtacgcncgtcgcgtctcgtacncgtntcgngc

SEQ ID NO: 149408 - DNA, 832 bp, Homo sapiens
  misc_feature: GYAE6OF01D8UMB.8.73.G07.1.454.CMB.1.raw
  modified_base (798)..(798): a, c, t, g, unknown or other
  misc_feature (798)..(798): n is a, c, g, or t
  modified_base (829)..(829): a, c, t, g, unknown or other
  misc_feature (829)..(829): n is a, c, g, or t
tcagctcgcgtgtccacgaccggtgctcgatttagctctacgctcagggtcctgggcccagtctgtactgacgcagccgccctcagtatctcggggccccagggcagagggtctccatctcctgcactgggagcagaaccagcagtcggggctaggttatgattgttactagttcggtaacccgccgtaggttcccaggcaccacgccccctagaacccttcctactacttaagttagaacttaaaccaaccaacgttcccgggacccttaccggtacggggttcctacgtacgtaccgtactttcctccgtcgtacccgtccgaagttccgtacggacttaacctttcgtccgtcccccttccgtacggttactaacttacgttccggttacgggttaccggtaccggtagggggttagaacggtagtacggtacggtacgttagttaacttttaacgttacctacggtaaccccttactaacctacgtacgtaacctacgacgtaccgtagtacgtttacgttggtcgttacgggttaccggaccgggtacggtaaccttacggttacccggaccgtttaccgtaccgttacgacccggacccgtaacgggttccctaccccgggtccccgttaccggttacacccgtttcccggttcccgtttacccccctaccgttaccccgtacggaaccgtaccggtaccgttaccgccgggttaacgggaccgggttcccggggtaacggttaccccgggacggtaaaacccgggtcccggtaaacggtacccgggttaanccgtagtcgtctacgtcgacacgtaccgcgngtc

SEQ ID NO: 149409 - DNA, 899 bp, Homo sapiens
  misc_feature: GYAE6OF01BOMBO.8.73.G07.1.454.CMB.1.raw
  modified_base (884)..(884): a, c, t, g, unknown or other
  misc_feature (884)..(884): n is a, c, g, or t
  modified_base (889)..(889): a, c, t, g, unknown or other
  misc_feature (889)..(889): n is a, c, g, or t
  modified_base (892)..(892): a, c, t, g, unknown or other
  misc_feature (892)..(892): n is a, c, g, or t
  modified_base (895)..(896): a, c, t, g, unknown or other
  misc_feature (895)..(896): n is a, c, g, or t
tcagctcgcgtgtccacgaccggtgctcgatttagctctacgctcagggtcctgggcccagtctgtactgacgcagccgccctcagtatcgtggggccccagggcagagggtctccatctcctgcacgtgggagcagaaccagcagtcgggctaggttatgattgttctagttggtacccgcgtaggttccaggccacgaccgccccagacctcctatattaatagaactaacaacgtaacgtccgcccgtggacgggttcctcgtacgtaccgtactttccgtacgtccgtacctacccgtaaggttccgtacggccttaacctttccgtaccgtcccgttcccggtgttacctaatcgttcgtaccggttccgtacgggtacgggtaggtaacgtgtacgggtaacgttcttaaggttaacttttaacgtaccgttacccgtacccttaccttaacgtacgtaaccggaacctaaccgtacggtacgtttacggtaaagtttttcgggtcgggtttccgggttacgggtaccggggggtacccggttaaccgggttaaacccggggtttaaccggttaccccgggtttaaccccggtttaacccggttacccggtaaacccggtaacccgggtaccccgttaacgggttaccccccgtttccccggttaccccccggttaacggtttccccggtttaacccttccccgggttttaccccccggtttcccccggttacccccgttaccgggtaccccgtaacccggtaccggggtaacccggtaccgggtcccggttacgggtaacccggggcccgggtaaccgggtaaccgggtaacccgggaacgggtttaccgaacggttacgaacgtggcccttagggncgtcncancgnngcg

SEQ ID NO: 149410 - DNA, 534 bp, Homo sapiens
  misc_feature: GYAE6OF01EHIM8.8.73.G07.1.454.CMB.1.raw
  modified_base (281)..(281): a, c, t, g, unknown or other
  misc_feature (281)..(281): n is a, c, g, or t
  modified_base (335)..(335): a, c, t, g, unknown or other
  misc_feature (335)..(335): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (525)..(534): a, c, t, g, unknown or other
  misc_feature (525)..(534): n is a, c, g, or t
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtacccgcaggttccaggcacacgcccccagactcctcattaatgaataacaacaatccggccctcgaggggtctctgaccgtattctctgcctccaagtctggctacttcngcctcctggtcatatcgtggtctccgagggtgagatgaggctagtatttatacncgcctactcctatcgaacaacgagtcctagtattagtttggcgttggttcgggccgggacgggactaaggttcgaccgttctaccgtcacgaccaaggcctccgccccgtcgctacctcctccgttccccgccctcnccgacncgcgtacgctaggaggccggcgtcggacgacggaccgacgagtaggnnnnnnnnnn

SEQ ID NO: 149411 - DNA, 803 bp, Homo sapiens
  misc_feature: GYAE6OF01E2KIO.8.73.G07.1.454.CMB.1.raw
  modified_base (778)..(778): a, c, t, g, unknown or other
  misc_feature (778)..(778): n is a, c, g, or t
  modified_base (789)..(789): a, c, t, g, unknown or other
  misc_feature (789)..(789): n is a, c, g, or t
  modified_base (794)..(794): a, c, t, g, unknown or other
  misc_feature (794)..(794): n is a, c, g, or t
  modified_base (798)..(798): a, c, t, g, unknown or other
  misc_feature (798)..(798): n is a, c, g, or t
  modified_base (800)..(800): a, c, t, g, unknown or other
  misc_feature (800)..(800): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgattgttcagtttcggtacccgccgtaggttccaggcacacgcccccagacctcctactaattaatgaactaaaccaactaacgtccggaccctcggaacggggttcctcgtacggaccgttacttccttcgtcgcccttaccgaagttcctcgggtacctacctttccgtacggtcccccgttcccggttcggtactatttacgtccggttcggttcccgtacccgggaagggggtttacggaaagggtaggtacgggtaacgggtcgtttaaggtactttttaaggttacctccggtacccctaaccttaccgttaagtaccgaacctaaacgtccgtcgtttacggttaaggttttacggtttgggtcggttcgggttcggggtaccgggtacgggtaaccgtacgggttaccggacccgttccgtacggtaccgaccggacccgtacggtcccgtcccggtccccgttcggtaccctaccggtttccgttacccggtttccccccgcccgttacccgttaccggacccgtaccggtaccggtacggtaccgttcgggacgggacccgggtcggtacgggaacccggtacgggacccgtaacgtacggtacgggacncgagtacgcgngacgngcgngngcg

SEQ ID NO: 149412 - DNA, 781 bp, Homo sapiens
  misc_feature: GYAE6OF01EAYHS.8.73.G07.1.454.CMB.1.raw
  modified_base (158)..(158): a, c, t, g, unknown or other
  misc_feature (158)..(158): n is a, c, g, or t
  modified_base (773)..(781): a, c, t, g, unknown or other
  misc_feature (773)..(781): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcacgtgggagcagaaccagcatcggggcaggttangatgtcattggtaccgctaggttccaggcacacgccccagtactcctcattaatgaataacaacatccggccctcgaggggtctcgtagaccgtattctactcgaccctacctaaagttccgtacggtcccttactttcgtccgtccccttccccgtcggtaaccttaactttacgttccgttcgggttacccgtaccggtaacggggttggaaacgggtgtagggaaggtaccgttaggtaactttttacgttttaaccgaccggtccccttaaaacccttcgttaaacgtaaacgtaaacccgaaaaagtcccggttaacccggtagggtttaaacgtttttaagttttcccgggggttacggtttaacggggttttcccgggggaacccgggggtaaccggggttaaacccgtaacgtttacccgggaacccgtttacccgttaaaccggttcccgaacgggtaccccgaaggggttacccttccccgggtaccccccgttcggtaaccttccgtttccggttccccttccccgtccccttcccgtacgaaccctacggcgtacgccgtagcgggcggtaggtccggaggtacgaccggactagtcagtgcnnnnnnnnn

SEQ ID NO: 149413 - DNA, 826 bp, Homo sapiens
  misc_feature: GYAE6OF01BQFCS.8.73.G07.1.454.CMB.1.raw
  modified_base (292)..(292): a, c, t, g, unknown or other
  misc_feature (292)..(292): n is a, c, g, or t
  modified_base (798)..(798): a, c, t, g, unknown or other
  misc_feature (798)..(798): n is a, c, g, or t
  modified_base (820)..(820): a, c, t, g, unknown or other
  misc_feature (820)..(820): n is a, c, g, or t
  modified_base (822)..(822): a, c, t, g, unknown or other
  misc_feature (822)..(822): n is a, c, g, or t
tcagctcgcgtgtccacgaccggtgctcgatttagctctacgctcagggtcctgggcccagtctgtactgacgcagccgccctcagtatcgtggggccccagggcagagggtctccatctcctgcactgggagcagaaccagcagtcggggcaggttatgatgttcagttcggtaccgccaggttccaggcacacgcccccagacctcctacattaatgaataaacaacaatccggaccctcgacgggtcctcgtacgacctattctctcgcctccaagtctggctacttcncgccttccgtggtacattacgtcgttcggttcctccggaggggtgacgggtagtcgggagtcttaggttaacttttaacttaccgtcgtaccctaccgttaccgttaagtaccgtaaaccaaacgtccggtaccgttaaggttacgtttaacggtttccggggtaccgtttcggggtttacccgggggcccggggtaaccggggtaacccgttaagggtttacccgggtaaccccgtttcccgttaaccgggtaccccgtaaccggtaccccgtaaacgggttccccgttcccccgggtacccccccggtttaccgggtaccccttacccgtttcccccgtttacccccggtttaaccccccctaccccccgttacccggttaacccggacccggtaacccgggtacccgggtaacggttcccggttagggtaacccggggcccggggttacggtaccgggggtaaacccgtaaacgggggccccgttaaacggaacgttacgggngcacggcgttacgcgtagagcngngtcg

SEQ ID NO: 149414 - DNA, 639 bp, Homo sapiens
  misc_feature: GYAE6OF01DWV0C.8.73.G07.1.454.CMB.1.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (596)..(596): a, c, t, g, unknown or other
  misc_feature (596)..(596): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (631)..(639): a, c, t, g, unknown or other
  misc_feature (631)..(639): n is a, c, g, or t
tcagctcgcgtgtccacgaccggtgctcgatttagctctacgctcagggtcctgggcccagtctgtactgacgcagcccgccctcagtatctggggccccagggcagagggtctccatctcctgcactggggagcaagaaccagcagtcggggcaggttatgtatgttcagtttcggtacccgcgtaggttccaggcaacaccgcccccagacctcctactattaaatgtaactaaaacaacctaagtcccggccctacggacggggttctccgtacgaccgtacttcctcctcgcctacctaagtcctggtaccttaccttcgccgtccccttaccggtgtcctaattntccgttggtccgtacggtaggggtagaggtagngtaggtctagttacttaactcgtaccnccgtaacttccgtagtaacaaaccgtaacgctccgtaaggttagtttacgtttcggtcggttcgggtaccggggaccgggtaccgggtaccgtacggttccgtaaccgtctacgtaccgacgaccgacgcccgtccgccccgtctcctcctccgttccctcccgaccctcacgaccgacgcgacgngcgacggcggcgtcggacgacggngacngtcngcnnnnnnnnn

SEQ ID NO: 149415 - DNA, 893 bp, Homo sapiens
  misc_feature: GYAE6OF01AI4TD.8.73.G07.1.454.CMB.1.raw
  modified_base (875)..(875): a, c, t, g, unknown or other
  misc_feature (875)..(875): n is a, c, g, or t
  modified_base (885)..(885): a, c, t, g, unknown or other
  misc_feature (885)..(885): n is a, c, g, or t
tcagctcgcgtgtccacgaccggtgctcgatttagctctacgctcagggtcctgggcccagtctgtactgacgcagccgccctcagtatctcggggccccagggcagagggtctccatctcctgcacgtggagcagaaccagcagtcggggcaggttatgatgttcagttcggtacccgcctacggttccaggcacacgccccccagacctcctacgtatttaactaggtaacttaaaccaaacgaaccgttcccgggaccccgttacggaacgggggtttcctccgttacggtaacccggttactttccgttccgttcgtaccccgtacccgtaaacggttccgtacgggtcctaaccggtttcctcgtccccgtaccccgttagggtaccctaaatttcgttccggttacgggtccgttacccggtaggggttaggtacgggtagtcggggaacggtcgtacggtttaactttacgttacccgttccggtacccttaaccgttaccttacgtaacgaacccgtaacggtaccgtaccgtaacggtttacggttacgtttcgggtccggtttgggttacccgggccgggttaacccgggtaccgttaacgggttacccgtaccggtttacccgtacggttacccgaccggtacccggtaacgggtcccgttaccccgggttcccccgttacgggtccccgttacccggtttcccgtttccccgggttacccccttcccgttaacccggtaccggtaccccggtaacggtccgggtaaccggttccgggccgggtaaccggggtcccggggttacccggtaccgggacggtaaacccggggtccgtaacggtacgggtagccggtcgagcccggngtacgctacncgtcgcgc

SEQ ID NO: 149416 - DNA, 689 bp, Homo sapiens
  misc_feature: GYAE6OF01B64VH.8.73.G07.1.454.CMB.1.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (672)..(672): a, c, t, g, unknown or other
  misc_feature (672)..(672): n is a, c, g, or t
  modified_base (676)..(676): a, c, t, g, unknown or other
  misc_feature (676)..(676): n is a, c, g, or t
  modified_base (678)..(679): a, c, t, g, unknown or other
  misc_feature (678)..(679): n is a, c, g, or t
  modified_base (681)..(681): a, c, t, g, unknown or other
  misc_feature (681)..(681): n is a, c, g, or t
  modified_base (683)..(687): a, c, t, g, unknown or other
  misc_feature (683)..(687): n is a, c, g, or t
  modified_base (689)..(689): a, c, t, g, unknown or other
  misc_feature (689)..(689): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactggggagcaagaaccagcagtcggggcaggttatgatgttcagtttcggtaccgccgtacggttccaggcaaccaccgccccctacgacctcctacaattaatagaaactaaaccaaactaacgtccggccctacggacggggtctcgtcgaccgtattcctctcgccctaccgtaacgtctacggctaccttcncgtccctccgttcggtactatacgtcgtacggtccgtccggtagggtgaggtacgnggacggtcgttagtacttaacttacggtccaccttactacttaacgtcgaaaccgtacgacttaccggttaggtacgtttagttcggtcgttcgggtacccgggcgggtaacggtacgtacgggttaccgtaccgtaccgttaccgtacgacccgtaccggtaccggaccgtcccggtcccccgttcgtacccgttaccgttcccgttacccgttccccggtaccctcccgtaccgtaccgccggtacgtacgcggtacggcggtcgggacgtcgaacggacggtcgacgtaagntcgncnncncnnnnngn

SEQ ID NO: 149417 - DNA, 1031 bp, Homo sapiens
  misc_feature: GYAE6OF01EZ733.8.73.G07.1.454.CMB.1.raw
  modified_base (1009)..(1009): a, c, t, g, unknown or other
  misc_feature (1009)..(1009): n is a, c, g, or t
  modified_base (1014)..(1014): a, c, t, g, unknown or other
  misc_feature (1014)..(1014): n is a, c, g, or t
  modified_base (1025)..(1025): a, c, t, g, unknown or other
  misc_feature (1025)..(1025): n is a, c, g, or t
  modified_base (1027)..(1027): a, c, t, g, unknown or other
  misc_feature (1027)..(1027): n is a, c, g, or t
  modified_base (1029)..(1029): a, c, t, g, unknown or other
  misc_feature (1029)..(1029): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcatttggaccgaccgacgtaccgtacggcgaccacgccccaccgactccctcctaacttaatagtaactaaacaaaaccaaacgtaccggtaccccgtccgtaacggggttccggttcctacgtaccggtaaccttcctttccgttcggccccttaccccgtaacggtacgttcgggcctaaccttttccgtcgtccccgttcccccttcgggttactaacttaatttccgttcgggtttccgttaccccgtaaggggggtgggtaaagggtaggttaaggtacggggtaccgtttaggttaagtttttaaaaccttttaccgttccgggacccctttaaacccgttcccccttttaaagttaccgggtaaaaccaaaaccccgtaacccggtttcccggttacggttaaacggttttttaaaggtttttcgggggttaccgtttacccggggtttttacccggggggggaccccggggggtaaccccggggggttaaccccgtttaaaaacgggtttttacccggggtaacccccccgtttccccggtttaaaaccccggtttacccgaaaacccggggtccccccggtaaacggggtttaccccccgttcccccggggttacccccccccggtttccccggggtttaacccgtacccttttaccccgttttcccccggggtttcccccccccgttacccccgttccccctacccggggttaaacccgacccgggttaccccgaaggggtttccccttaacggggggaaccgggcccggggggtacccgttagggaccccggggttaaaacccgggcggggtaaacccttaaccgttaggaaccngacgnacgtcgacgancngntg

SEQ ID NO: 149418 - DNA, 691 bp, Homo sapiens
  misc_feature: GYAE6OF01D30HR.8.73.G07.1.454.CMB.1.raw
  modified_base (568)..(568): a, c, t, g, unknown or other
  misc_feature (568)..(568): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
  modified_base (686)..(686): a, c, t, g, unknown or other
  misc_feature (686)..(686): n is a, c, g, or t
tcagctcgcgtgtccacgaccggtgctcgatttagctctacgctcagggtcctgggcccagtctgtactgacgcagccgccctcagtatcgtggggccccagggcagagggtctccatctcctgcactgggagcagaaccagcagtcggggcaggttatgatgttcattggaccgcaggttccagcacgcgccccagactcctcattaatgaactaacaacgaacgtccgccctacgagggtctcgtcgaccgtattcctctcgcccttaccgaagttccgtggactacctttcgaccgtccccttccgttagtctattactcgttggttccaccggtgggtacgagggtatggacggtagtacgtattacttacctcggacctaccttctaacgtcaaccgaacgtcgtcgtagtaagtttacgttggttccgtgggttccgggaccgggtacgggtaaccgtaaacgggttccggtaaccccggttacttaccggacctacggacccttaacgggccctcccgggccccgtttaccggacctccgttaccgttcccgtttaccccncccgttcgtaacccgtaccgccgttaccggacgtcggttaccggcgggtcccggtcggtcggaacccgtggggtaccctaacgtcgttaagggcttaancggctactnacgttccagngcacg

SEQ ID NO: 149419 - DNA, 811 bp, Homo sapiens
  misc_feature: GYAE6OF01DJGZ5.8.73.G07.1.454.CMB.1.raw
  modified_base (787)..(787): a, c, t, g, unknown or other
  misc_feature (787)..(787): n is a, c, g, or t
  modified_base (798)..(798): a, c, t, g, unknown or other
  misc_feature (798)..(798): n is a, c, g, or t
  modified_base (802)..(804): a, c, t, g, unknown or other
  misc_feature (802)..(804): n is a, c, g, or t
  modified_base (806)..(807): a, c, t, g, unknown or other
  misc_feature (806)..(807): n is a, c, g, or t
  modified_base (809)..(809): a, c, t, g, unknown or other
  misc_feature (809)..(809): n is a, c, g, or t
  modified_base (811)..(811): a, c, t, g, unknown or other
  misc_feature (811)..(811): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaccagcagtcgggcaggttatgatgttcagttcggtacccgccgaggttccgaggccaaccgaccggccccccaagaccttccctactaatttaaacgtaggaacttaaacccaaactaaaccgtcccggtacccccgttcggaaccgggggttccttaccgtacgaacccggtatttccctcgtccgtccctaccgtaagttcctcggtacctacctttccgtcgtcccccttcccgttggtcctaacgtccgaccgttcgggccttaccgacggtcgtacgtacgagtacgacggtctaggtaaacttttacgtacgtaccgtacccgtaggttaacctagttaacggttacgaaaccgtacggccgttaacccggttccggttttcgggttttaaccggggttttttcggggttccgggtttaaccggggaccggggtaacgggaaccccgtaacgggtcccgtaccggttaacccgttcccgtcggtacccgttaaccgacccgtaccgaccggttcccgtccccgtcccccggttgtaccctcccttacccgttccccgttaaccccctacccgtcccgtacggtaccgacccggtacggaccggtacgtcgggccgggccggtaggaccgggacgttcggaacccgngttacgaccgngcgnnngnngngn

SEQ ID NO: 149420 - DNA, 945 bp, Homo sapiens
  misc_feature: GYAE6OF01EH42U.8.73.G07.1.454.CMB.1.raw
  modified_base (135)..(135): a, c, t, g, unknown or other
  misc_feature (135)..(135): n is a, c, g, or t
  modified_base (927)..(927): a, c, t, g, unknown or other
  misc_feature (927)..(927): n is a, c, g, or t
  modified_base (940)..(940): a, c, t, g, unknown or other
  misc_feature (940)..(940): n is a, c, g, or t
  modified_base (943)..(943): a, c, t, g, unknown or other
  misc_feature (943)..(943): n is a, c, g, or t
tcagctcgcgtgtccacgaccggtgctcgatttagctctacgctcagggtcctgggcccagtctgtactgacgcagccgccctcagtatctcggggccccagggcaggagggtctccatctcctgcacgtgggancagaaccagcacgtcggggctaggttatgatgttctagttcggtacccgccgtacggttccgacggcgaccaccggccccccacgtaccttccctactaatttaaactagtaaactaaacctaaaccgtaacggtcccggtccccgttaccggtacgggggttcctaccgtacgtaccggtacctttccgtccgtacgtccctaccgtaacgtccgtcggtcctacctttctccgtcccctcccgttggtacctattcgtcgttacggttccgtaccggtaggggtggaacggtagttcgggacggtaccgttaggtttaacttttaacgtttccgtaccggtacccctaccgtttacccttaaacggttacgaaacccgtaacgtaccgttaccggtttaagtttacgggttttaacgtttccgggttccggtttacgggggtttcccgggtaccgggggttaacccggggtaaccggttaaccggttttaccccgggaacccggtttacccgttaacccggtacccgtaacccgggtaaccccggtaccgggttccccgttacccccggggtccccccggtttaccgtacccccgtttacccgtttcccccgggtttaacccctttacccccccttccccggttaacccccggttccccgaacccgggtaccccggtacgggttacccgtccggggtttaaccggaccgggggttccgggtaccccggttacggggacccggttaaacggggcccgtaacccgggttaacgtaggacccttgacggtacncgtctacgagtcncgngc

SEQ ID NO: 149421 - DNA, 949 bp, Homo sapiens
  misc_feature: GYAE6OF01BO77R.8.73.G07.1.454.CMB.1.raw
  modified_base (132)..(132): a, c, t, g, unknown or other
  misc_feature (132)..(132): n is a, c, g, or t
  modified_base (921)..(921): a, c, t, g, unknown or other
  misc_feature (921)..(921): n is a, c, g, or t
  modified_base (941)..(941): a, c, t, g, unknown or other
  misc_feature (941)..(941): n is a, c, g, or t
  modified_base (945)..(945): a, c, t, g, unknown or other
  misc_feature (945)..(945): n is a, c, g, or t
tcagctcgcgtgtccacgaccggtgctcgatttagctctacgctcagggtcctgggcccagtctgtactgacgcagccgccctcagtatctggggccccagggcagagggtctcatctcctgcactggggancacgaaccgagcagtcggggcaggttatgatgttacagttcggaccgtcaggttccaggcacacgccccagtactccactaattaatgaataaacaaacaacgtccggtaccctacggaagggggttcctcgtacggaacccgtaattccgtacctcggcccttaacccgtaaagttccgtaggggtacctaacctttcccttaccgggtaccccttcccccggttagggttctaaacgttacgtttcccgttaggttaccccgttaaccggagggggttagtacgggggtagtaacggtaacgggtccgttaggttaaagttttaacgtttaaacccgtggaaacccccgttaaccttaccgttaacggtaaacgtaaccctaaaaccggaacgggttcccgtttaaaggggtaacgtttttaacgggtttccgggttaccggttaggggtttaaccccggggacgggggtaaccccgggggttaacccggtttaaaccgggtttaccggttaaccccgttaccccggtttaaacccgggttaccaaccccggggttaaccccggtaaacgggttacccggttaccccgggtaccccccggttaccggtacccgttacccgtttaccgttaccccgttttaccccccgtaccccgtttacccgaaccccgtaaccggtaacccgggtaccgggtaaccgtaccggttacgggaccgggtacgggttaccgggtacgggaacccggtaccggggaaacccgaacggttaactaggtacacgggtaactnaaccggacttacggacgaanacgngtac

SEQ ID NO: 149422 - DNA, 960 bp, Homo sapiens
  misc_feature: GYAE6OF01BNW03.8.73.G07.1.454.CMB.1.raw
  modified_base (930)..(930): a, c, t, g, unknown or other
  misc_feature (930)..(930): n is a, c, g, or t
  modified_base (956)..(956): a, c, t, g, unknown or other
  misc_feature (956)..(956): n is a, c, g, or t
  modified_base (959)..(960): a, c, t, g, unknown or other
  misc_feature (959)..(960): n is a, c, g, or t
tcagctcgcgtgtccacgaccggtgctcgatttagctctacgctcagggtcctgggcccagtctgtactgacgcagcccgccctcagtatcgtcggggccccagggcaggaggtctccatctcctgcacgtgggagacaacgaaccgagcgaggtcggggactaggttatagattgttctagttcggacccgtccgtacggttaccgaggaccaccgacccggaccccctagtacccttacccttactaatttaaacgtacgtaaaacttaaacccgaaactaaccggttcccggtacccgtaccggttacgggtccgttaccgtaccggttaacctcttttccgtccgttccgcccttacgtagtccgttcggccttaccttcgtcccgttcctccggttgacgtacttacgtcgttaccggttcgaccggtagggtacgagtacgtacggtcggtaacttacgttaacgttaccgtttaacgcccgttacccgtaacctttaagttacccgtaacggtaaaccctaccgtaacccggtttattacgggtttaacccggtttaggtttccggggttacccggtttcggggtaaacccgggggttcccggggttaacccggggtttaaaccgggttaaccgggtttaacccccgggttaccccgtttaacccggtttacccggtaaaccccggtacccggggttaaccccgttaccccggggttaccccgttccccccgggtttaaccccccgtttccccgggttaccccgtttacccgttttacccccggttccccccgttaccccccgtacccccggttaaccccggtaaacccggtacccgggcccggtacgggttacccggaacgggtcccggggaccgggttccggaccggggaaaccgcgggttaacccggacgttaacgacgnggacctgtacctagacggtgactgcncgnn

SEQ ID NO: 149423 - DNA, 698 bp, Homo sapiens
  misc_feature: GYAE6OF01DM2ED.8.73.G07.1.454.CMB.1.raw
  modified_base (132)..(132): a, c, t, g, unknown or other
  misc_feature (132)..(132): n is a, c, g, or t
  modified_base (668)..(668): a, c, t, g, unknown or other
  misc_feature (668)..(668): n is a, c, g, or t
  modified_base (687)..(698): a, c, t, g, unknown or other
  misc_feature (687)..(698): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggancaagaaccagcagtcggggctaggttatgattgttcagttggtaccgccgaggttccaggcacaccgcccccagacctcctacattaatgaactaaacaactaacgtccgcccgtcgaggggtctcgtgaccgtacttcctctcgtccctaccgacgtctcggctaccttctcgtcccttccgtggtctattcgtccgttcggttcctacggaggggtacgagggtgtggagggtcttaagttaacttttattaaccgtcgtaccctaccttaccgtaacgtacgaaaccgtaacgtaccgtaccgttagttaacggtttcggttttcgggtccggtttgggtttcccgggggaccgggtacccgggtaaccgtaacgggttcccggtaaccccgttaccgttaccgaccgtaccggaccggttaccggtccccgtccccgtacccccgttcgtccctacttcccgttcccggttcccccgtccctccgtaccgaccgaccgcggtacggtcgtcggacggtcgggtcgaccgggngtaaccggcgactaggtgnnnnnnnnnnnn

SEQ ID NO: 149424 - DNA, 873 bp, Homo sapiens
  misc_feature: GYAE6OF01AEMK2.8.73.G07.1.454.CMB.1.raw
  modified_base (141)..(141): a, c, t, g, unknown or other
  misc_feature (141)..(141): n is a, c, g, or t
  modified_base (151)..(151): a, c, t, g, unknown or other
  misc_feature (151)..(151): n is a, c, g, or t
  modified_base (835)..(835): a, c, t, g, unknown or other
  misc_feature (835)..(835): n is a, c, g, or t
  modified_base (848)..(848): a, c, t, g, unknown or other
  misc_feature (848)..(848): n is a, c, g, or t
  modified_base (855)..(855): a, c, t, g, unknown or other
  misc_feature (855)..(855): n is a, c, g, or t
  modified_base (859)..(859): a, c, t, g, unknown or other
  misc_feature (859)..(859): n is a, c, g, or t
  modified_base (863)..(863): a, c, t, g, unknown or other
  misc_feature (863)..(863): n is a, c, g, or t
  modified_base (867)..(867): a, c, t, g, unknown or other
  misc_feature (867)..(867): n is a, c, g, or t
  modified_base (871)..(871): a, c, t, g, unknown or other
  misc_feature (871)..(871): n is a, c, g, or t
tcagctcgcgtgtccacgaccggtgctcgatttagctctacgctcagggtcctgggcccagtctgtactgacgcagccgccctcagtatcgtcgggggccccagggcaggagggtcctccattcctcctgacacgtgggancaacgaaccngtacgaggtccgggggctaggttactgtacgtagttcgtaggttccggtacccgccgtacggttccgacgaccaccgacccgaccccctaagtacccttacctacgttaaatttaaagtgtaaaacctaaaccgaaacctacgtcccggtaccgtcgggtacgggttccttacgacgttacgtactttccttaccgccgttaccacgtaggtccgttacgtacttaccgtttcgtacccgtaccgttccgtaccgttataaccgttcgttacgggttccggaccgttacgggttaggggagggttaccgagggtttacggaccggtttaacgtttaacggtttaaacttttccccgttacggtacccgtaaccccgttactttaacgggtaccgtaaaccgaaccccgttaacggtccggtttccgggttaagtttacgggttccggttttcggggttaccggtaacggggtttccccgggggaacgggttaaccccggttacggttaccggtaccggttacccgttacggtaccgtaccggaccgtaaccgggtccgttaccccgtccggtaccccgttcggtacccttccgttacccgttacccgtcccctaccgtcccgaaccggtccgaccggtcggaccgggttacgtccgggaacgggtcccggcgggtacgaccggnggttaccagggtnacggtcngcancgtncganctgncg

SEQ ID NO: 149425 - DNA, 768 bp, Homo sapiens
  misc_feature: GYAE6OF01BDYPS.8.73.G07.1.454.CMB.1.raw
  modified_base (147)..(147): a, c, t, g, unknown or other
  misc_feature (147)..(147): n is a, c, g, or t
  modified_base (684)..(684): a, c, t, g, unknown or other
  misc_feature (684)..(684): n is a, c, g, or t
  modified_base (701)..(701): a, c, t, g, unknown or other
  misc_feature (701)..(701): n is a, c, g, or t
  modified_base (707)..(707): a, c, t, g, unknown or other
  misc_feature (707)..(707): n is a, c, g, or t
  modified_base (750)..(750): a, c, t, g, unknown or other
  misc_feature (750)..(750): n is a, c, g, or t
  modified_base (757)..(757): a, c, t, g, unknown or other
  misc_feature (757)..(757): n is a, c, g, or t
  modified_base (759)..(759): a, c, t, g, unknown or other
  misc_feature (759)..(759): n is a, c, g, or t
  modified_base (761)..(762): a, c, t, g, unknown or other
  misc_feature (761)..(762): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
tcagctcgcgtgtccacgaccggtgctcgatttagctctacgctcagggtcctgggcccagtctgtactgacgcagcccgccctcagtatcgtcggggcccccagggcaggagggtctccatctcctgcactgggagcgaagaaccngcaggtcggggctaggtttatgtattagttcctaagtttcgggtacccgccgtacggttccaacggccaaccgaccgccccccctaaggtcccttcctacgtaaacttttaaacgtagtaaacctaaaacctaaccgtaaacggttcccccggaccccgttacggtaaccgggggttccttcccgttacgggtaacccgttactttccctaccgttaccgtcccctaacccgtaaggttccgtaccggtaccttacctttccgtccggtaccccctttccccggtaggttacctacgtttacgttccggtttacggttaccgtccgggtagggtacgggtaaggtgacggtagtcgttaacgttatttaaccgtctaccgtaccctacttcgtagtaaccacaaccgtacgtccggtgttacgtttacgtcggtcggttacggtcgggaccggtacggtacctagggttccaccggttctccggacaccgggtcccagtcccgcccgtcccgtagtcctaccgtccttcccgtcccncccgttcgacacccggngtccgnggtactggaccggtcggacgtcgggaacctggcctagtcgcancgagtcngnannctangn

SEQ ID NO: 149426 - DNA, 757 bp, Homo sapiens
  misc_feature: GYAE6OF01EUX0O.8.73.G07.1.454.CMB.1.raw
  modified_base (132)..(132): a, c, t, g, unknown or other
  misc_feature (132)..(132): n is a, c, g, or t
  modified_base (731)..(731): a, c, t, g, unknown or other
  misc_feature (731)..(731): n is a, c, g, or t
  modified_base (736)..(736): a, c, t, g, unknown or other
  misc_feature (736)..(736): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggancagaaccagcagtcggggcaggtttatgatgttctagttggtacccgcgtacggttccaggcacacgcccccagtactcctactaatttaatacgaactaaacaactaagtccggtaccctcgacgggtctcgtagacgtacttctctcgcctactacgtcgtcggtctacgttctaccgtccttaccgtggttctattacgttcgttcggtctaccggtagggttcgaggaggttacgagttctaggttacttacgttacgtcgacccttacgtaacccgttagtacgtaaaccgaacgtacggtacggttaacggttaggttttaaccgttcgggtacgtttcggggtcgggtacccgggtacgggtaaccggttaacggttaccggtacccgtaccggttaaccgggtaccaacccggtaccggtaaccggtacccgttccccgtaccccggttccggttacccgtttaaccgttcccgtttacccgttaaccccccgttaccgtacccgttacccggaaccgacccggtacggtaccgttccgggtcggacgggtccgggaccggttacggaaccggtacggacgacgtacgtanacgtnactcgacttcgntncngngtc

SEQ ID NO: 149427 - DNA, 1120 bp, Homo sapiens
  misc_feature: GYAE6OF01EMZWK.8.73.G07.1.454.CMB.1.raw
  modified_base (1111)..(1111): a, c, t, g, unknown or other
  misc_feature (1111)..(1111): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggacggaccaacggaaacccagacaagtccggggggctaagggttaatgtaacttggttacctaagtttcgggtaacccgccccgtaaacgggggttttaccccgaaggggtacctaaacccgaaccgggtccccccccccaaaaggtaaaccccgtttccccttaacgtaaaacttttaaaagtacggtaaaaactttaaaaccgaaaaccgtaaaaacgttccccggggtaccccttaccggtaaggggggtttaccttccgttacggaacccggttaattttcccgttaccgttcgtaccccgttaacccgaaaaggtttccgtacgggtaccctaacttttccggtaaccggtccccgttacccccgtttagggtacctaaacgttttaacgtccgttaccggggtttaccctaacccggtagggggttaccgaaggggttaacttacggggtaaggtaccgttagttaaagttttaactttaaccggtacgtaccccgttaaactttaccccgttaaagtaccggtaaaccaaaacgtaccgtaccgttaggtaaacggttttaacggtttcgggtaccggtttacggggttaccggggtaccgggaaccgggggtaacccgtaaacgggtttacccggtaacccggtttaacccgttaacccggtaccggtaaaccggaaccccggttaaaccgggtaccccgtacccgggtttaccccccccggttaacggttaccccgtaacccgttttaccgttacccggttttaacccccccgtaccccctttaacccgttacccggaaacccgtaacccgggtacccggtaaaccgggttccgtttacgggaaccggggttacccgggggaaccccggtttaagggggaaacccggtaaaacccggggtccgttaaaaccgggtaacggtttaagggacgacggtaccggtaaggtcgtacggattaaacccggtctaaagngttaaccgg

SEQ ID NO: 149428 - DNA, 824 bp, Homo sapiens
  misc_feature: GYAE6OF01C7I79.8.73.G07.1.454.CMB.1.raw
  modified_base (136)..(136): a, c, t, g, unknown or other
  misc_feature (136)..(136): n is a, c, g, or t
  modified_base (402)..(402): a, c, t, g, unknown or other
  misc_feature (402)..(402): n is a, c, g, or t
  modified_base (766)..(766): a, c, t, g, unknown or other
  misc_feature (766)..(766): n is a, c, g, or t
  modified_base (812)..(812): a, c, t, g, unknown or other
  misc_feature (812)..(812): n is a, c, g, or t
  modified_base (815)..(815): a, c, t, g, unknown or other
  misc_feature (815)..(815): n is a, c, g, or t
  modified_base (817)..(817): a, c, t, g, unknown or other
  misc_feature (817)..(817): n is a, c, g, or t
  modified_base (819)..(824): a, c, t, g, unknown or other
  misc_feature (819)..(824): n is a, c, g, or t
tcagctcgcgtgtccacgaccggtgctcgatttagctctacgctcagggtcctgggcccagtctgtactgacgcagccgccctcagtatcgtcggggccccagggcaggaggtctccatcctcctgcacgtgggancaacgaaccgagcgagtcggggactaggttagtggtatgttacgtagttacggtacccgccgtaacggttcccgaaggtcaccgcccggaccccctaagtacccttcctactaaattttaacgaagtaaactaaaaccaaaccgtaaccgtccccgggtaccccgttagggaccggggttcctccggttaccgaacccggttacttttccgccgttaccgtaccctaacggttaaaccggtcgttaaccggcctttacccgttccnccgtccccttacgtacgtaactacttacggtttcgtcggttaccgtacggggtaggtaaggacggtaggtcgaacgtttcgtaattacgttactttacccgacttacccgtaacctttaaccgtaagacccgaaaaccgtaaccgtacggtaccgtttaggttacgtttaccggggtttcgttaccggggtttcgggtaccccggggacggggtttaacccgggtaaccgttaaccggttaccgtacccggttaccgtaccgaaccgtaccgtaccggtacgtcccgtcccgtcccgtcccgtacctccgttacccttcccgttcccgtaccctacccgtaccgaccgtacccggagtaccggngtacggcggcggtaccggacgggacgacggtcgaacgcgtgacgtnacngncnnnnnn

SEQ ID NO: 149429 - DNA, 839 bp, Homo sapiens
  misc_feature: GYAE6OF01ALQ6A.8.73.G07.1.454.CMB.1.raw
  modified_base (820)..(820): a, c, t, g, unknown or other
  misc_feature (820)..(820): n is a, c, g, or t
  modified_base (825)..(825): a, c, t, g, unknown or other
  misc_feature (825)..(825): n is a, c, g, or t
  modified_base (828)..(828): a, c, t, g, unknown or other
  misc_feature (828)..(828): n is a, c, g, or t
  modified_base (831)..(832): a, c, t, g, unknown or other
  misc_feature (831)..(832): n is a, c, g, or t
  modified_base (835)..(836): a, c, t, g, unknown or other
  misc_feature (835)..(836): n is a, c, g, or t
  modified_base (838)..(839): a, c, t, g, unknown or other
  misc_feature (838)..(839): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgattgttactagttcggtacccgtccgacggttcccgacggccaccgaccggacccccccgacggtaccttccctactaaacgtttaaagtcggaaacttaaaccaaaaccgtaacgttacccggaccccgttacggtacgggggttccttaccgtccggaacccggttactttcctccgttcgtcccttacccgtaaacgtccgtcgggtcctaaccgtttccgtaccggtcccttcccccgttgggtaccctaacgtttacttccggttacggttacccgttcccggtaaggggttacggtaacgggtaacgttttcgggaacgggttacgttacgttaactttttaaacggttacccgtcggtacccctaaccgttcccttaaacgacggtaaccaaccgtacgtccgttaggtaacgtttacgttcggtccgttcgggtccggggtacgggaccgggtaaccgttacggttacccgtaacccgttaccgttaccggtacccgtaaccggtacccggtaacggtcccgtcccccggtaccccgttccgggtccctaaccgttcccgtcccggtttaccccaccccgttccgtaaccgaccgccggtacgtacgccgtggtaccggccggtcgtacggacgtaccggacgtccgtaagcncggtncgntgnntanngnn

SEQ ID NO: 149430 - DNA, 680 bp, Homo sapiens
  misc_feature: GYAE6OF01CCJ5Q.8.73.G07.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (664)..(664): a, c, t, g, unknown or other
  misc_feature (664)..(664): n is a, c, g, or t
  modified_base (667)..(668): a, c, t, g, unknown or other
  misc_feature (667)..(668): n is a, c, g, or t
  modified_base (674)..(675): a, c, t, g, unknown or other
  misc_feature (674)..(675): n is a, c, g, or t
  modified_base (677)..(678): a, c, t, g, unknown or other
  misc_feature (677)..(678): n is a, c, g, or t
tcagctcgcgtgtccacgaccggtgctcgatttagctctacgctcagggtcctgggcccagtctgtactgacgcagccgccctcagtatctcggggccccagggcagagggtctccatctcctgcacgtgggagcagaaccagcagtcggggcagggttatgattgttcattcggtaccgccaggtccaggccacacgccccagactctcattangaataacaanaatcggcctgtagggtactctgacgtattcntcgcctaccgaagtctgctaccttcgtcgtcctccgtgtcaagtctcncggtcctcggaggtgaggtatacggaggtcttaaggtatttactactccgtacctacctctttaacgngaaccaacgtcgacgttagtagtttaggttttcggcggtttcggtccgggaccggggtaccgggtaacccgtaaggtttccggacccgttaccggtaccgttacgaaacccggtacccgaacggggtccctacccccgtccccggttaaccggtcccttaaccgttcccgtcccccgggtttacccctacccccggtttacccgttaccccggaaccgaccccggttacgaccgttccggaacggcggggtccgggacctggggaccgtaaaccgggcgtactaaggtccgncannctcacnncnngc

SEQ ID NO: 149431 - DNA, 757 bp, Homo sapiens
  misc_feature: GYAE6OF01DR1EJ.8.73.G07.1.454.CMB.1.raw
  modified_base (135)..(135): a, c, t, g, unknown or other
  misc_feature (135)..(135): n is a, c, g, or t
  modified_base (735)..(735): a, c, t, g, unknown or other
  misc_feature (735)..(735): n is a, c, g, or t
  modified_base (740)..(741): a, c, t, g, unknown or other
  misc_feature (740)..(741): n is a, c, g, or t
  modified_base (747)..(748): a, c, t, g, unknown or other
  misc_feature (747)..(748): n is a, c, g, or t
  modified_base (753)..(753): a, c, t, g, unknown or other
  misc_feature (753)..(753): n is a, c, g, or t
  modified_base (756)..(756): a, c, t, g, unknown or other
  misc_feature (756)..(756): n is a, c, g, or t
tcagctcgcgtgtccacgaccggtgctcgatttagctctacgctcagggtcctgggcccagtctgtactgacgcagccgccctcagtatcgtcggggccccagggcagacgggtctccatctctgcacgtgggancaacgaacacgcgaggtcggggactaggttataggattcgttctaggttacgggtacccgtaccggtacggttaccgacggaccaacccaccggacccccgagtacccttcctactaagttaacagtaactaaaccgaactaccgtccgtcccggtacggtacgggttcctacgtaccggtaccgttattcccgtcttaccgtccctacgtacgtcgtcgttaccctacttacggtcccgtaccgttcccggttagtactacttcgttccgggtaccgttccggtacgggaagggtacggtacggtagtacggacgttacgttagttaaccttaacgtcaccgtccgtaacctacgtaacgtcgaactactaggtccttggtacgttgttcgtacggttacgggcgggaccggtacggtacgtccgtacgtcccgttacgtaccgacctacggtaccgcgtcccgcccgttcccgtacggttccctaccgttccctaccccgtcccctaaccccgtctccccggaacaccggtgtaccggttcggaaccgggcgggttaccgacggggtacgaccggtaccgggcttacgggactggacncgtannctacgnnacgtncgng

SEQ ID NO: 149432 - DNA, 484 bp, Homo sapiens
  misc_feature: GYAE6OF02G1TQ0.8.73.G07.1.454.CMB.1.raw
  modified_base (474)..(484): a, c, t, g, unknown or other
  misc_feature (474)..(484): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggcctcgccccctggtcactctcgttcccaccctcctcgacacgcgagctgagcggctggcaggcgcatagnnnnnnnnnnn

SEQ ID NO: 149433 - DNA, 477 bp, Homo sapiens
  misc_feature: GYAE6OF02HIDCH.8.73.G07.1.454.CMB.1.raw
  modified_base (470)..(477): a, c, t, g, unknown or other
  misc_feature (470)..(477): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcgggacaagttgaccgtctacgtcagcccaaggctgcccctcggtccactctcgttcccaccctcctcgacacgcgagctgagcggctggcaggcgcatagnnnnnnnn

SEQ ID NO: 149434 - DNA, 487 bp, Homo sapiens
  misc_feature: GYAE6OF02IJ054.8.73.G07.1.454.CMB.1.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (476)..(487): a, c, t, g, unknown or other
  misc_feature (476)..(487): n is a, c, g, or t
tcagctcgcgtgtccacgaccggtgctcgatttagctctacgctcaggggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgataacaacaatcggccctcaggggtctctgaccgattctctgcctccaagtctggcacttcngcctccctggtcatatctggtctccagggtgaggntgaggctgattattactgccactcctatgacaacagctgagtatttggctgttcggcggcgggaccaagttcgaccgtcctacgtcagcccaaggcctcgcccctcgtcactctcgttcccacctcctcgaccacgcgagctgacgcggctggcaggcagatagnnnnnnnnnnnn

SEQ ID NO: 149435 - DNA, 480 bp, Homo sapiens
  misc_feature: GYAE6OF02HJPHY.8.73.G07.1.454.CMB.1.raw
  modified_base (305)..(305): a, c, t, g, unknown or other
  misc_feature (305)..(305): n is a, c, g, or t
  modified_base (470)..(480): a, c, t, g, unknown or other
  misc_feature (470)..(480): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacagcctgagtatttggctgttcgggcggcgggaccaagttgaccgtctacgtcagcccaaggctgcccctggtcactctgttcccaccctcctcgacacgcgagctgagcggctggcaggcgcatagnnnnnnnnnnn

SEQ ID NO: 149436 - DNA, 483 bp, Homo sapiens
  misc_feature: GYAE6OF02HQVCF.8.73.G07.1.454.CMB.1.raw
  modified_base (305)..(305): a, c, t, g, unknown or other
  misc_feature (305)..(305): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (473)..(483): a, c, t, g, unknown or other
  misc_feature (473)..(483): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacagctgagttatttggctgttcggcggcgggaccaagttgaccgtcctacgtcagcccaaggcctcgcccctcggtcactctcgttcccacctcctcgacncgcgagctgngcggctggcaggcgcntagnnnnnnnnnnn

SEQ ID NO: 149437 - DNA, 493 bp, Homo sapiens
  misc_feature: GYAE6OF02HBYEO.8.73.G07.1.454.CMB.1.raw
  modified_base (482)..(493): a, c, t, g, unknown or other
  misc_feature (482)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgccctccctggtcatatctggtctccagggtgaggatgaggctgattattactgccactcctatgacaacagcctgagtatttggcttgttcggcggcgggaccaagttcgaccgtcctacgtcagcccaaggctcgcccctcggtccactctcgttccccgtccctcctccgaccacgcgagctgcgcggctggcaggcgcagtagnnnnnnnnnnnn

SEQ ID NO: 149438 - DNA, 496 bp, Homo sapiens
  misc_feature: GYAE6OF02G6R65.8.73.G07.1.454.CMB.1.raw
  modified_base (485)..(485): a, c, t, g, unknown or other
  misc_feature (485)..(485): n is a, c, g, or t
  modified_base (488)..(496): a, c, t, g, unknown or other
  misc_feature (488)..(496): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgaataacaacaatccggccctcgaggggtctctgaccgattctctgcctccaagtctggcacttctgcctccctggtcatatctggtcctccgagggtgaggatgaggctgattattactgccacttcctatgacaacagctgatattgctggttcggcggcgggacaagttcgaccgtcctacgtcacgcccgaaggcctcgcccccttcggtccactctcgttccccaccctcctcgacaccgcgagctgcggcggctggcagggcacganagnnnnnnnnn

SEQ ID NO: 149439 - DNA, 499 bp, Homo sapiens
  misc_feature: GYAE6OF02GRTKQ.8.73.G07.1.454.CMB.1.raw
  modified_base (343)..(343): a, c, t, g, unknown or other
  misc_feature (343)..(343): n is a, c, g, or t
  modified_base (487)..(488): a, c, t, g, unknown or other
  misc_feature (487)..(488): n is a, c, g, or t
  modified_base (490)..(499): a, c, t, g, unknown or other
  misc_feature (490)..(499): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactctatgacaacngcctgagtattggctgttcggcggcgggacaagttgaccgtcctacgtcagtcccaaggctcgcccctcggtcacgtctcgttcccaccctcctccgacaccgcgagcctggacgccgggcgtcggccagggccgcgaagtagnntnnnnnnnnnn

SEQ ID NO: 149440 - DNA, 500 bp, Homo sapiens
  misc_feature: GYAE6OF02IKH83.8.73.G07.1.454.CMB.1.raw
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (492)..(500): a, c, t, g, unknown or other
  misc_feature (492)..(500): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttcncgcctccctggtcatatctggtctccagggtgaggatgaggctgattatactgccactcctatcgacaacngcctgagttatttggcttggttcggcggcgggacctaagttcgaccgtctacgtcagcccaaggcctcgcccctggtccnctctcgttccccacctctccgaccncgcgagctgacgcgggctacggcaggcgacgngtagnancgnnnnnnnnn

SEQ ID NO: 149441 - DNA, 496 bp, Homo sapiens
  misc_feature: GYAE6OF02HUIBA.8.73.G07.1.454.CMB.1.raw
  modified_base (305)..(305): a, c, t, g, unknown or other
  misc_feature (305)..(305): n is a, c, g, or t
  modified_base (465)..(465): a, c, t, g, unknown or other
  misc_feature (465)..(465): n is a, c, g, or t
  modified_base (485)..(496): a, c, t, g, unknown or other
  misc_feature (485)..(496): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacacagctgagtatttggctgttcggcggcgggacaagttgaccgtcctacgtcagcccaaggcctcgccccttcggtccacgtctcgttcccaccctcctccgaccacgcgagctcgagtccgggntcggcaagggcgcgatacgnnnnnnnnnnnn

SEQ ID NO: 149442 - DNA, 499 bp, Homo sapiens
  misc_feature: GYAE6OF02IRJD1.8.73.G07.1.454.CMB.1.raw
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (488)..(499): a, c, t, g, unknown or other
  misc_feature (488)..(499): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcaggggtctctgaccgattctctgcctccaagtctggcacttctgccctccctggtcatatctggtcctccagggtgaggatggagctgatttattactgccactcctaatgacaacagcctagagtatttcggcttgttcgggcggcgggaccaagttcgaccgtcctacgtcacgcccgaaggctcgcccctcggtccactcctcgtcccnccctcctcgaccncgcacgctgacgcggctggacaggcgacatagnnnnnnnnnnnn

SEQ ID NO: 149443 - DNA, 485 bp, Homo sapiens
  misc_feature: GYAE6OF02FH9NG.8.73.G07.1.454.CMB.1.raw
  modified_base (475)..(485): a, c, t, g, unknown or other
  misc_feature (475)..(485): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgcccctcggtcactctcgttccccgccctcctcgacacgcgagctgacgcgggctggcaggcgcatgnnnnnnnnnnn

SEQ ID NO: 149444 - DNA, 485 bp, Homo sapiens
  misc_feature: GYAE6OF02GBM0E.8.73.G07.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (476)..(485): a, c, t, g, unknown or other
  misc_feature (476)..(485): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacngcctgagtatttggctgttcggcggcgggaccaagttgaccgtcctacgtcagcccaaggctcgccccctcggtccactcctgttcccgccctcctcgacacgcgagctgagcggctggcaggcgcagtagnnnnnnnnnn

SEQ ID NO: 149445 - DNA, 666 bp, Homo sapiens
  misc_feature: GYAE6OF02FKKZ6.8.73.G07.1.454.CMB.1.raw
  modified_base (132)..(132): a, c, t, g, unknown or other
  misc_feature (132)..(132): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggancagaaccagcatcggggcaggttatgatgttcattggtaccgccaggttccaggcacagcccccagactcctcattaangataacacaatcggccctnagggtctctgaccgattctctgcctccaagtctggctacttctgcctcctggtcatatctaggtctccgagggtcaggattcggaggtcttagtactttattaccgtgacctacttcctatcgaacctaacgagtccctagacgtaattttcgggacttggttcggcggtccggggtacctaaggttcgaaccgtcctacggtcctaagccccgtaaggtcccttcggacccccgttcggtacctaaccgttccgttacggtttccccgacccgtttcccgtaccggtaaccgtaccggtaccggtacggtacccgttagggaaccgtccggggttccttaccggggtacctaaccggggtccgtaccgtaacggttaccggacgttacgtaccgtacgtacggtaccgtacgtaccggtgttaccgagttaccgg

SEQ ID NO: 149446 - DNA, 493 bp, Homo sapiens
  misc_feature: GYAE6OF02F1MBG.8.73.G07.1.454.CMB.1.raw
  modified_base (326)..(326): a, c, t, g, unknown or other
  misc_feature (326)..(326): n is a, c, g, or t
  modified_base (482)..(493): a, c, t, g, unknown or other
  misc_feature (482)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattacngccactcctatgacaacagcctgagtatttggcttgttcggcggcgggaccaagttcgaccgtcctacgtcacgcccaaggctcgcccctcggtcactctcgttcccaccctcctcgacacgcgagctgacgcgggctgggcaggcgacgaatagnnnnnnnnnnnn

SEQ ID NO: 149447 - DNA, 485 bp, Homo sapiens
  misc_feature: GYAE6OF02FSMCS.8.73.G07.1.454.CMB.1.raw
  modified_base (474)..(485): a, c, t, g, unknown or other
  misc_feature (474)..(485): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagtgaccgtcctacgtcagcccaaggctcgcccctcggccactctcgttcccaccctcctcgacacgcgagctgacgcggctggcaggcgcgatagnnnnnnnnnnnn

SEQ ID NO: 149448 - DNA, 629 bp, Homo sapiens
  misc_feature: GYAE6OF02ITDR9.8.73.G07.1.454.CMB.1.raw
  modified_base (619)..(620): a, c, t, g, unknown or other
  misc_feature (619)..(620): n is a, c, g, or t
  modified_base (622)..(629): a, c, t, g, unknown or other
  misc_feature (622)..(629): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactggggagcagaaccagcagtcggggcaggttatgatgttcattggtaccgccaggttccaggcacagcccccagactcctcattaatgaataaacaacaatccggcctcgagggtctctgaccgattctctcgcctaccaagtctggcacttctgccctcccgtggtctatactcgtggtcctccgagggtgaggatgaggctgtattatactgccactcctatacgaacaacacgtccgtagtaagttagttttcgggctttcgggttccgggcgggtaccggggaaccgtaacggtttcggaacccgttcccgtaaccgtccgacggtacccgaaacgggtcctcccggtcccccgttacgggttccctaaccttcccgtttaccgttaccccctaccccgttcccgttacccggaccgtaccggtccggaacggtcccgtagaccgggtcgggccgtcgggaccgaacgggcgtacgaacgtaggcacgnngnnnnnnnn

SEQ ID NO: 149449 - DNA, 484 bp, Homo sapiens
  misc_feature: GYAE6OF02H3WEN.8.73.G07.1.454.CMB.1.raw
  modified_base (474)..(484): a, c, t, g, unknown or other
  misc_feature (474)..(484): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcaggggtctctgaccgattctctgcctccaagtctggcacttctgcctccctggtcatatctggtctccaggtgaggatgaggctgattattactgccactcctatgacaacagcctgagtatttggcttgttcgggcggcggacaagttcgaccgtctacgtcacgccaaggctcgcccctcggtcactcctcgtcccgccctcctcgaccacgcgagctgagcggcgtggacaggcgcgatgnnnnnnnnnnn

SEQ ID NO: 149450 - DNA, 476 bp, Homo sapiens
  misc_feature: GYAE6OF02JGVJH.8.73.G07.1.454.CMB.1.raw
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (458)..(476): a, c, t, g, unknown or other
  misc_feature (458)..(476): n is a, c, g, or t
tcagctcgcgtgtccacgaccggtgctcgatttagctctacgctcagggtcctgggcccagtctgtcctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcgggcgagggaccaagttgaccgtctaggtcagcccaaggctcgccccctggtcactctcgttcccacctctcgacncgcgngctgacgcgggctcggcaggcgcatcgnnnnnnnnnnnnnnnnnnn

SEQ ID NO: 149451 - DNA, 480 bp, Homo sapiens
  misc_feature: GYAE6OF02HQZ2M.8.73.G07.1.454.CMB.1.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (470)..(480): a, c, t, g, unknown or other
  misc_feature (470)..(480): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacacagctgagtatttggctgttcggcggcggaccaagttgaccgtctacgtcagcccaaggctcgcccctcggtcacttctcgtcccnccctctcgacncgcgagctgacgcggctggcaggcgacatagnnnnnnnnnnn

SEQ ID NO: 149452 - DNA, 577 bp, Homo sapiens
  misc_feature: GYAE6OF02IOAPO.8.73.G07.1.454.CMB.1.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (541)..(541): a, c, t, g, unknown or other
  misc_feature (541)..(541): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (574)..(576): a, c, t, g, unknown or other
  misc_feature (574)..(576): n is a, c, g, or t
tcagctcgcgtgtccacgaccggtgctcgatttagctctacgctcagggtcctgggcccagtctgtactgacgcagccgccctcagtatctggggccccagggcagacgggtctccatctcctgcactgggagcagaaccagcatcggggcaggttatgatgttcattggtaccgccaggttccaggcacagcccccagactcctcattaatgataacaacaatcggccctcgaaggggtctctcgacgattcgtctgcctaccaagtctggcacttctgcctccctggtcaatatcgtggtctccgaggtgagatgaggctgatttagttaacncgacacttcctatanaacgtaacaagtcctagacgttagtttgacttcggttacgggcggtcggggaacctaacggtttcgaaccggttccgtacgtcacgacccgaaaggcctacgccccttcggtcctacctcctccgtttcccgaccccttccgttccgaccgaccgcgacgtccttaggcggtcggccgtgggaccacgggngcccgtaaggtacgcgacgtcgngcgcncnncnnnc

SEQ ID NO: 149453 - DNA, 635 bp, Homo sapiens
  misc_feature: GYAE6OF02HB5FW.8.73.G07.1.454.CMB.1.raw
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
tcagctcgcgtgtccacgaccggtgctcgatttagctctacgctcagggtcctgggcccgagtctgtactgacgcagccgccctcagtatctcggggccccagggcagagggtctccatctcctgcactgggagcagaaccagcatcggggcaggttatgatgttcattggtaccgccaggttccaggcacaggcccccagacctcctcattaatgataacaacaatcggccctcaggggtctctgaccgattctctgcctccaagtctggcacttctgcctccctggtcatatctggtctccgagggtcaggagtgaggctgtattacttactcgcctactcctaagtcgacaacgcgcctgaagttagttttcggacttggtttccgggcgggtaccggggtacctaaggtttcgaacccggttccttaaccggttcaacgtacccgaaagggtccttccggcccccgttcggtacctaccgttccgttccggtttcccccgccccgttccgtacccggaaccgtaccggaccgtaacgcccgttacgggacgggtcccgggccgttacgggaccgtaacggggccggtacgtaacgttaggacgacgacgtagngaccgtnacgacncntcg

SEQ ID NO: 149454 - DNA, 489 bp, Homo sapiens
  misc_feature: GYAE6OF02GJLZ4.8.73.G07.1.454.CMB.1.raw
  modified_base (455)..(455): a, c, t, g, unknown or other
  misc_feature (455)..(455): n is a, c, g, or t
  modified_base (480)..(489): a, c, t, g, unknown or other
  misc_feature (480)..(489): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggcttgttcggcggcgggaccagttgaccgtcctacgtcacgcccaaggcctcgccccctcggtccactcctcgttccccgccctccctcgacacgcgngctgacgcggctggcaggcgcatgnnnnnnnnnn

SEQ ID NO: 149455 - DNA, 504 bp, Homo sapiens
  misc_feature: GYAE6OF02GIO46.8.73.G07.1.454.CMB.1.raw
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
  modified_base (493)..(504): a, c, t, g, unknown or other
  misc_feature (493)..(504): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctccaagtctggcacttcngcctcctggtcatatctggtctccgaggtgaggntgaggctgattattactgccactcctatcgacaacngctgagttatttggcttggttcggcggacgggaccgtaagttcgaccgtcctacgtcacgcccaacggctcgcccctcggtcctactcctcgttcccacccgtccctcgaccncgcgagctgacgcgggcgtggcaggcgacgagagnnnnnnnnnnnn

SEQ ID NO: 149456 - DNA, 823 bp, Homo sapiens
  misc_feature: GYAE6OF02G26GI.8.73.G07.1.454.CMB.1.raw
  modified_base (812)..(812): a, c, t, g, unknown or other
  misc_feature (812)..(812): n is a, c, g, or t
  modified_base (814)..(814): a, c, t, g, unknown or other
  misc_feature (814)..(814): n is a, c, g, or t
  modified_base (816)..(816): a, c, t, g, unknown or other
  misc_feature (816)..(816): n is a, c, g, or t
  modified_base (818)..(823): a, c, t, g, unknown or other
  misc_feature (818)..(823): n is a, c, g, or t
tcagctcgcgtgtccacgaccggtgctcgatttagctctacgctcagggtcctgggcccagtctgtactgacgcagccgccctcagtatctggggccccagggcagagggtctccatccctcgcgactggagggcacgaaccgaacgacgactacggggccgggaggttaagttagtagtgtttctattaggttaccggacccgacggttaccgtacggacgacacgccccgacccgacgtccctcctattaaattagataaactaaaccaaactaccggtccccgtcccgtaggggtacggttcctcgtaccggacgttcttcctcgcctcccctaaacgtacgttcggtccgacctttcctttcgcccgttcccccttcgggttccgtaactaattcgttcgggttccgttccctaacgggggtgggtaacgggaagttggaggggacgtggtatttaagttttaaccttcggccctaacccttaccttactagtaaccgaaaccaaacggtcccttacggtaggttaattttcggggtcttcggtttccggggtccggggaccggggaacccggtaaacgtttacgggtaccccggttaccccttacccggttacgtaaccggacccgaaacgggtaccgttcccggtcccccccgttcccgggttaccgtaacccttcccgtttccgggtttccccccggttccccctcccccttccggtaacccgaacccgtaccggtacgtcggtaacgggccggggtcccggttcggaccggaacgggccgggtccaacgtaacggtgcacgcgngngncnnnnnn

SEQ ID NO: 149457 - DNA, 663 bp, Homo sapiens
  misc_feature: GYAE6OF02I6OV3.8.73.G07.1.454.CMB.1.raw
  modified_base (643)..(643): a, c, t, g, unknown or other
  misc_feature (643)..(643): n is a, c, g, or t
  modified_base (650)..(650): a, c, t, g, unknown or other
  misc_feature (650)..(650): n is a, c, g, or t
tcagctcgcgtgtccacgaccggtgctcgatttagctctacgctcaggggtaccctgggcccgaaccgtctgtactgacgtcagtcccgccctcagttatctggggccccacgggcagacgggtccgtccaattctccttgcactgggagccaggaaccacgcattcggggcacggttagtgatgttccacttggtacccgcaggttccgaggcacagccccctaggtactcctcgagttaattcgtataacctaacgtaaactcgggcccctacgaacggggttctcctggacccgtacttcgtcctcgcccttccaagtcgtggccacttcctacgccgtcccctaggtcgactaatccctaggtcctccgtaggggttgagggtactgggtagggccgttgggattaacgttacttgaccctacttcctaacttgaccaacacggccttggacgttactttgggacttaggttttcggcggtacgggtacctaagttcgaccgttcgtacgtcgacgcccgaaggcctcggcccccttggtcctaccgtctacggttcccacccgtccgtcgaccgacgtacgacgtcgttcgagtccggcgtcggacgtacggtccggtacctacgtaacgtctcgcgntcgagtntgtgtatgtacgg

SEQ ID NO: 149458 - DNA, 491 bp, Homo sapiens
  misc_feature: GYAE6OF02F2MOY.8.73.G07.1.454.CMB.1.raw
  modified_base (448)..(448): a, c, t, g, unknown or other
  misc_feature (448)..(448): n is a, c, g, or t
  modified_base (480)..(491): a, c, t, g, unknown or other
  misc_feature (480)..(491): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtccatatctggtctccgagggtgaggatgaggctgattattactgccactcctatgacaacagcctgagttatttggcttgttcggcggcgggaccaagttgaccgtcctacgtcagcccaaggctcgcccctcggccactctcgttcccaccctcctccgacnccgcgacgctgagcggctggcaggcgcatagnnnnnnnnnnnn

SEQ ID NO: 149459 - DNA, 490 bp, Homo sapiens
  misc_feature: GYAE6OF02HOKNP.8.73.G07.1.454.CMB.1.raw
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (442)..(442): a, c, t, g, unknown or other
  misc_feature (442)..(442): n is a, c, g, or t
  modified_base (478)..(479): a, c, t, g, unknown or other
  misc_feature (478)..(479): n is a, c, g, or t
  modified_base (481)..(484): a, c, t, g, unknown or other
  misc_feature (481)..(484): n is a, c, g, or t
  modified_base (486)..(490): a, c, t, g, unknown or other
  misc_feature (486)..(490): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctcctggtcatatctggtctccagggtnaggntgaggctgattattactgccactcctatgacaacngcctgagtatttggcttgttcggcggcggacagttgaccgtctacgtcacgccaaggctcgcccctcggtccactctcgtccccgccctcctccgacnccgcgagcctgacggcggctggcgaggcgcagtagnngnnnncnnnnn

SEQ ID NO: 149460 - DNA, 670 bp, Homo sapiens
  misc_feature: GYAE6OF02JYUBW.8.73.G07.1.454.CMB.1.raw
  modified_base (135)..(135): a, c, t, g, unknown or other
  misc_feature (135)..(135): n is a, c, g, or t
  modified_base (160)..(160): a, c, t, g, unknown or other
  misc_feature (160)..(160): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
tcagctcgcgtgtccacgaccggtgctcgatttagctctacgctcagggtcctgggcccagtctgtactgacgcagccgccctcagtatctggggccccagggccaggagggtctccgatctcctgcactgggancagaaccagcatcggggcaggttangatgttcattggtaccgccaggttccaggcacacgcccccagacctcctcacttaatgaataaacaacaatccggaccctcgaggggtctcgtgaccgtattcctctcgcccttccaagttctggctacttctgcccttccgtggtccagttactcgttcggtcctccgagggttcgaggtatggaggctaggtatttagttacgtcgacccacttccctaattagaacctaaacgcgtccttaggtacgtttattttcggggctttcgggttaccgggcggggtacccggggtaacgtaacgggtttccgtaacccggttccgtaaccgttccgaccgtacccgaacgggtccctaccggtacccccgttcggtacctacccgttccgttacccgttcccctaccccgttccgtacccgtacccgacggtccgacgtccgttacgacgggtcggacgtggaccgtacggcgtaccggaattacggctacgcacgcgcacgcgacncgnc

SEQ ID NO: 149461 - DNA, 507 bp, Homo sapiens
  misc_feature: GYAE6OF02GANR4.8.73.G07.1.454.CMB.1.raw
  modified_base (356)..(356): a, c, t, g, unknown or other
  misc_feature (356)..(356): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (496)..(497): a, c, t, g, unknown or other
  misc_feature (496)..(497): n is a, c, g, or t
  modified_base (500)..(507): a, c, t, g, unknown or other
  misc_feature (500)..(507): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgataacaacaatcggccctcgaggggtctctgaccgattctctgcctccaagtctggcacttctgccctcctggtccattatctggtctccgaggtgaggatgagctgattattactgccactctatgacaacagcctgagttntttggcttggttcggcggcgggactaagttcgaccgtcctacgtcacgccaaggctcgccccttcggtcacttctcgttcccgcccttccncgacnccgcgagccgtgacgcggcgtcggacgacggcgacgagtagcanncgnnnnnnnn

SEQ ID NO: 149462 - DNA, 486 bp, Homo sapiens
  misc_feature: GYAE6OF02F5668.8.73.G07.1.454.CMB.1.raw
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (478)..(486): a, c, t, g, unknown or other
  misc_feature (478)..(486): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcgggcggcgggaccaagttgaccgtcctacgtcagcccaaggcctcgcccctcggtcactctcgttcccaccctcctccgacnccgcgngctgacgcggctggcaggcgcatagnnnnnnnnn

SEQ ID NO: 149463 - DNA, 514 bp, Homo sapiens
  misc_feature: GYAE6OF02HO4PZ.8.73.G07.1.454.CMB.1.raw
  modified_base (434)..(434): a, c, t, g, unknown or other
  misc_feature (434)..(434): n is a, c, g, or t
  modified_base (503)..(514): a, c, t, g, unknown or other
  misc_feature (503)..(514): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatcgtggtcctccgagggtgaggatggaggctgatttattactgccactcctatgacaacacgcctgagttatttggctggttcggcggcgggaccaagttcgaccgtcctacgtcacgcccgaaggctccgccccgttcggtccncttcctcgttcccgtcccctccgtccgacaccgcgacgctgacggcggccgtggccgaggcgcgatagnnnnnnnnnnnn

SEQ ID NO: 149464 - DNA, 496 bp, Homo sapiens
  misc_feature: GYAE6OF02JFY9J.8.73.G07.1.454.CMB.1.raw
  modified_base (435)..(435): a, c, t, g, unknown or other
  misc_feature (435)..(435): n is a, c, g, or t
  modified_base (484)..(487): a, c, t, g, unknown or other
  misc_feature (484)..(487): n is a, c, g, or t
  modified_base (490)..(496): a, c, t, g, unknown or other
  misc_feature (490)..(496): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggcttgttcggcggcgggaccaagttcgaccgtctacgtcacgcccaaggctcgccccttcggccactcctcgttcccnccctcctcgacacgcgagctggagccgggctggcaggccgcgacgtagnnnncgnnnnnnn

SEQ ID NO: 149465 - DNA, 500 bp, Homo sapiens
  misc_feature: GYAE6OF02HJSPI.8.73.G07.1.454.CMB.1.raw
  modified_base (346)..(346): a, c, t, g, unknown or other
  misc_feature (346)..(346): n is a, c, g, or t
  modified_base (453)..(453): a, c, t, g, unknown or other
  misc_feature (453)..(453): n is a, c, g, or t
  modified_base (489)..(489): a, c, t, g, unknown or other
  misc_feature (489)..(489): n is a, c, g, or t
  modified_base (491)..(500): a, c, t, g, unknown or other
  misc_feature (491)..(500): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatgaggctgatttattactgccactcctatgacaacngcctgagtatttggcttgttcgggcggcgggaccgagttcgaccgtcctacgtcacgccgaaggcctcgccccttcggtccactctcgttcccaccctcctcgaccncgcgcgctcgagccgggctcgggcacggcgctaagngnnnnnnnnnn

SEQ ID NO: 149466 - DNA, 510 bp, Homo sapiens
  misc_feature: GYAE6OF02IK2VJ.8.73.G07.1.454.CMB.1.raw
  modified_base (274)..(274): a, c, t, g, unknown or other
  misc_feature (274)..(274): n is a, c, g, or t
  modified_base (496)..(497): a, c, t, g, unknown or other
  misc_feature (496)..(497): n is a, c, g, or t
  modified_base (499)..(506): a, c, t, g, unknown or other
  misc_feature (499)..(506): n is a, c, g, or t
  modified_base (508)..(510): a, c, t, g, unknown or other
  misc_feature (508)..(510): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttcngcctcctggtcatatctggtctccgagggtgagatgagctgattatatgccactcctatgacaacagctagagttatttggcttgttcgggcggcgggacctaaggttcgaccgtcctacgtcacgcccgaaggcctcgcccctcggtccaccttctcgttccccgccctctccgaaccgcgacgcgtcgacgcgggcgtcgggacgacggcgacgagtacnncnnnnnnnncnnn

SEQ ID NO: 149467 - DNA, 532 bp, Homo sapiens
  misc_feature: GYAE6OF02IWP54.8.73.G07.1.454.CMB.1.raw
  modified_base (255)..(255): a, c, t, g, unknown or other
  misc_feature (255)..(255): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (529)..(532): a, c, t, g, unknown or other
  misc_feature (529)..(532): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgataacaacaatccggccctcgaggggtctctgaccgattcncttgcctccaagtctggcactttctgccctcccctggtcctagtatccgttggtcttcccgagggtcgaggatgaggctgatttattacngcccactcctatcgactaacngcctgagtatttggcttggttcggcggcgggaccaaggttcgaccgtcctacgtcacgccaaggcctcggcccctcggtcacgtcctcgttcccgccctccgtccgacgccgacgcgtctgacgcgggctggccgaggccgacgagtacgngncancngntcnnnn

SEQ ID NO: 149468 - DNA, 487 bp, Homo sapiens
  misc_feature: GYAE6OF02HMH5U.8.73.G07.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (475)..(476): a, c, t, g, unknown or other
  misc_feature (475)..(476): n is a, c, g, or t
  modified_base (479)..(487): a, c, t, g, unknown or other
  misc_feature (479)..(487): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctcaagtctggcacttcngcctccctggtcatatctggtctccgagggtnaggatgaggctgatttatactgccactcctatgacaacngcctgagtatttggctgttcggcggcggaccagttgaccgtcctacgtcagccaaggcctcgcccctggtccacttctcgttcccnccctcncgacncgcgagctgacgcggctggcaggcgacgatagnngcnnnnnnnnn

SEQ ID NO: 149469 - DNA, 677 bp, Homo sapiens
  misc_feature: GYAE6OF02JA2H2.8.73.G07.1.454.CMB.1.raw
  modified_base (314)..(314): a, c, t, g, unknown or other
  misc_feature (314)..(314): n is a, c, g, or t
  modified_base (668)..(669): a, c, t, g, unknown or other
  misc_feature (668)..(669): n is a, c, g, or t
  modified_base (672)..(677): a, c, t, g, unknown or other
  misc_feature (672)..(677): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcccctccgtggtcatatcgtggtcctccgagggtgaggntggacgctagtatttattactcgacctaccgttacctatacgaacaacgacgccgtagacgtttagtttcggcgtttacgggtttccgggccgggtaccgggtaaccgttaacggtttccggtaaccccgttacccgttacgtaccgaccgtaccccgaagggtcccgttccccgtcccccggttaccgggtcccttaacccgttccccgtttccccgttacccccctaccccgtttaccccgaacccgtacccgaccccgggtacggaccgttccggtaacgggccggggtcccgggtaccgtaccggggaaccggtaccgggcccgaacgtttaacggcgtacgcacggtcnncgnnnnnn

SEQ ID NO: 149470 - DNA, 493 bp, Homo sapiens
  misc_feature: GYAE6OF02JDF44.8.73.G07.1.454.CMB.1.raw
  modified_base (482)..(484): a, c, t, g, unknown or other
  misc_feature (482)..(484): n is a, c, g, or t
  modified_base (486)..(493): a, c, t, g, unknown or other
  misc_feature (486)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggaacagcccccagcctcctcatctataataataacattcggccctcaggggtccctgaccgcttctctggctccaagtctggctcctcagcctccctggccatcactgggctccaggctgacgatgagctgattatactgccagtcatatgacagcagctgtcgtttttgggtggttcggcgggagggaccaaggtctacggaccgtccgtgcgtcacgcccaaggcctcgccccctggtccacgtctcgtccccacctctccgacacgcgagctgacgcggctggcaaggcgcatnnngnnnnnnnn

SEQ ID NO: 149471 - DNA, 494 bp, Homo sapiens
  misc_feature: GYAE6OF02HB0J1.8.73.G07.1.454.CMB.1.raw
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
  modified_base (484)..(486): a, c, t, g, unknown or other
  misc_feature (484)..(486): n is a, c, g, or t
  modified_base (488)..(494): a, c, t, g, unknown or other
  misc_feature (488)..(494): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgccctcctggtcatatctgtctccagggtgaggatgaggctgattattactgcctactcctatgacaacagcctgtagtntttggctggttcggcggcggacgagttcgaccgtctacgtcacgccaaggctcgcccctcggcnctctcgtcccnccctcctcgacncgcgacgctgcggccggcgtcggacgacggcgacagtagncnnncnnnnnnn

SEQ ID NO: 149472 - DNA, 508 bp, Homo sapiens
  misc_feature: GYAE6OF02FG1K5.8.73.G07.1.454.CMB.1.raw
  modified_base (349)..(349): a, c, t, g, unknown or other
  misc_feature (349)..(349): n is a, c, g, or t
  modified_base (494)..(495): a, c, t, g, unknown or other
  misc_feature (494)..(495): n is a, c, g, or t
  modified_base (501)..(508): a, c, t, g, unknown or other
  misc_feature (501)..(508): n is a, c, g, or t
tcagctcgcgtgtccacgaccggtgctcgatttagctctacgctcagggtcctgggcccagtctgtactgacgcagccgccctcagtatctggggccccgagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggctacttctgcctccctggtcatactctggtctccagggtgaggatgagctgattattacgtgccacctcctatgacaacgngcctgagtatttggctgttcggcggcggacaagttgaccgtcctacgtcacgcccaaggctcgaccccgtcgtcactctcgttccccacccgtcctcgaccgacgcgagctagacgcgggctcggactagggccacgacgtaagnngtcagnnnnnnnn

SEQ ID NO: 149473 - DNA, 627 bp, Homo sapiens
  misc_feature: GYAE6OF02GH29J.8.73.G07.1.454.CMB.1.raw
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (602)..(602): a, c, t, g, unknown or other
  misc_feature (602)..(602): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaatgataacaacaatcggccctcgagggtctctgaccgattctctgcctccaagtcnggcacttcngcctcctgtcatatctggtctccgagggtgaggatgaggtctgtattattactcgcctactcctaatgaaccaacgacgtccgtagtagtttagtttacgggccttggttccgggcgggtaccggggtacctaaggtttcggaccccgttccgtacggtacgacgtacccgaacgggtccctacccggtcccccgttcgggtccctaaccgttccgttccgttaccccctacccgttccccgtaccgacccgtacggacccggaacgtccgtacgggacggtccgggtccgtacgggaccgtacgggccgtaccgtaagtacggtccngacgcgtagacgtccgngcngngcg

SEQ ID NO: 149474 - DNA, 493 bp, Homo sapiens
  misc_feature: GYAE6OF02HRV3W.8.73.G07.1.454.CMB.1.raw
  modified_base (275)..(275): a, c, t, g, unknown or other
  misc_feature (275)..(275): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
  modified_base (482)..(483): a, c, t, g, unknown or other
  misc_feature (482)..(483): n is a, c, g, or t
  modified_base (485)..(493): a, c, t, g, unknown or other
  misc_feature (485)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctnccctccctggtcatatctggtctccagggtgaggatgaggctgattattactgccactcctatgacaacagtcctgagttatttggcttgttcgggcggcgggacctaaggtcgaccgtcctacgtcagcccaaggcctcgcccctcggtcactctcgtcccnccctcctcgacacgcgagctgngcggctggacaggcacgntagnncnnnnnnnnn

SEQ ID NO: 149475 - DNA, 496 bp, Homo sapiens
  misc_feature: GYAE6OF02HSC67.8.73.G07.1.454.CMB.1.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
  modified_base (486)..(496): a, c, t, g, unknown or other
  misc_feature (486)..(496): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataaacaacaatcggccctcgaggggtctctgaccgattctctgcctccaagtctggcacttctgcctccctggtcatactctggttctccgagggtgaggatgaggctgtattatactgccactcctatcgacaacagcctgagttattggcttggtcggcggcggactagttcgaccgtcctacgtcacgcccaggctcgcccctcgtcactctcgttcccnccctccncgacnccgcgcnctgacgcggngtgcgaggcgacgatagnnnnnnnnnnn

SEQ ID NO: 149476 - DNA, 486 bp, Homo sapiens
  misc_feature: GYAE6OF02GAMKP.8.73.G07.1.454.CMB.1.raw
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (475)..(486): a, c, t, g, unknown or other
  misc_feature (475)..(486): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtgaggatgaggctgattattactgccactcctatcgacaacngcctgattatttggcttgtcggcggcggacagttcgaccgtctacgtcacgccaaggctcgcccctcggtccactctcgtcccaccctcctcgacncgcgngctgacgcggctggcgaggccacagtacgnnnnnnnnnnnn

SEQ ID NO: 149477 - DNA, 485 bp, Homo sapiens
  misc_feature: GYAE6OF02HBI93.8.73.G07.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
  modified_base (473)..(476): a, c, t, g, unknown or other
  misc_feature (473)..(476): n is a, c, g, or t
  modified_base (479)..(485): a, c, t, g, unknown or other
  misc_feature (479)..(485): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgccctccctggtcatatctggtctccgagggtgaggntggaggctgattattactgccactcctatnacaacngctgagttatttggcttggttcggcggcgggacagtcgaccgtctacgtcagcccaaggcctcgcccctggtccactctcgtcccncctcncgacncgcgagctgcgcggctggcaggcncgatagnnnngcnnnnnnn

SEQ ID NO: 149478 - DNA, 487 bp, Homo sapiens
  misc_feature: GYAE6OF02IKWDH.8.73.G07.1.454.CMB.1.raw
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (478)..(487): a, c, t, g, unknown or other
  misc_feature (478)..(487): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacagcccccagactcctcattaatgataacaacaatcggccctcgagggtctctagaccgattctctgcctcaagtctaggcacttcngcctcctggtcatatctggtctcaggtnagntgnggctgtattatatgccactcctatgacaacagcctagagttattggcttgttcgggcggtcgggacctaaggttcgacgtctacgtcacgccaaggctcgccctggtccactctcgtcccgcctctccgacncgcgagcngacgcggcgtgacgacgcgnaagtacgncnnnnnnnnnn

SEQ ID NO: 149479 - DNA, 505 bp, Homo sapiens
  misc_feature: GYAE6OF02FRJBG.8.73.G07.1.454.CMB.1.raw
  modified_base (494)..(505): a, c, t, g, unknown or other
  misc_feature (494)..(505): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctggttcggcggcgggaccaagttgaccgtctacgtcacgcccaaggcctcgcccccttcggtccactcctgttccccaccctcctccgacaccgcgacgctgacgccgggctcgggacacgggcgacgtatacgnnnnnnnnnnnn

SEQ ID NO: 149480 - DNA, 498 bp, Homo sapiens
  misc_feature: GYAE6OF02F9PED.8.73.G07.1.454.CMB.1.raw
  modified_base (489)..(498): a, c, t, g, unknown or other
  misc_feature (489)..(498): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatgagctgattattactgccactcctatgacaacagcctgagttatttggcttggttcgggcggacgggacctaaggttcgaccgtcctacgtcacgcccaaggcctcgcccctcggtcactctcgtcccactcctcctcgaccacgcgagcgtgacgcgggctggcgaaggcgcatagnnnnnnnnnn

SEQ ID NO: 149481 - DNA, 535 bp, Homo sapiens
  misc_feature: GYAE6OF02HB9YA.8.73.G07.1.454.CMB.1.raw
  modified_base (312)..(312): a, c, t, g, unknown or other
  misc_feature (312)..(312): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
  modified_base (530)..(535): a, c, t, g, unknown or other
  misc_feature (530)..(535): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgataacaacaatcggccctgaggggtctctgaccgattctctgcctccaagtctggcacttctgccctccctggtccattatctggtcctccgagggttnaggatgagctgatttatactgccacttcctatgacaacagcctgagttatttggcttggttcggcgggcggactagttcgaccgtcctacgtcagacccaagtccgtccgtccccgtcggtcctactcgtccgttccccacccttccgaccgaccaccgccgagtccgttaggacgggcggcgtgggaccgagggcgaccgagtacgntancnncgcnnnnnn

SEQ ID NO: 149482 - DNA, 521 bp, Homo sapiens
  misc_feature: GYAE6OF02IIPLX.8.73.G07.1.454.CMB.1.raw
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (510)..(521): a, c, t, g, unknown or other
  misc_feature (510)..(521): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgagggtctctgaccgattctctgcctccaagtctggcacttctgccctcctggtcatatctggtcctccgagggtnaggntgaggctgtatttattactcgccacttccctatgacaacngcctgagttattggcttggtcggcggcgggaccagttcgaccgtcctacgtcacgcccaaggcctcgcccccgttcggtccaccttccttccgttccccaccctccctccgaccaccgcgacgcgtgacggccgggcgtggccgaggccgacgaatagnnnnnnnnnnnn

SEQ ID NO: 149483 - DNA, 496 bp, Homo sapiens
  misc_feature: GYAE6OF02F1JHI.8.73.G07.1.454.CMB.1.raw
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
  modified_base (485)..(496): a, c, t, g, unknown or other
  misc_feature (485)..(496): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatgaggctgattattactgccactcctatcgacaacagcctgagtatttggcttggttcggcggcgggaccaagtcgaccgtcctacgtcacgcccaaggctcgccccttcggtccactctcgttcccaccctcctcgaccncgcgacgctgacgcggctggcacggcncgatagnnnnnnnnnnnn

SEQ ID NO: 149484 - DNA, 504 bp, Homo sapiens
  misc_feature: GYAE6OF02FGL94.8.73.G07.1.454.CMB.1.raw
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (492)..(498): a, c, t, g, unknown or other
  misc_feature (492)..(498): n is a, c, g, or t
  modified_base (500)..(504): a, c, t, g, unknown or other
  misc_feature (500)..(504): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatccggccctcaggggtctctgaccgattctctgcctccaagtctggcacttctgcctccctggtcatatctggtctccgaggtgaggatgaggctgatttattactgccactcctatgacaacngcctgagtntttggctggttcggcggcgggaccagtgaccgtcctacgtcacgcccaaggctcgcccctcggtccaccttcgtcttccccaccctcctccgacaccgcgacgcgttgacggcgggctcggacgagggcgcgaatgnnnnnnngnnnnn

SEQ ID NO: 149485 - DNA, 562 bp, Homo sapiens
  misc_feature: GYAE6OF02ISOJ8.8.73.G07.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (501)..(501): a, c, t, g, unknown or other
  misc_feature (501)..(501): n is a, c, g, or t
  modified_base (549)..(549): a, c, t, g, unknown or other
  misc_feature (549)..(549): n is a, c, g, or t
  modified_base (551)..(562): a, c, t, g, unknown or other
  misc_feature (551)..(562): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataaacaacaatccggccctcgaggggtctctgaccgattctctcgcctcaagtctggcacttctcgcctcctgtacatntctcggtctccgtaggngaggatggagcttagtatttacgttactcgcctaacttccctaataccggaacaacgacgccgttgtaacgtttagttttcgggactttcgggttcgggcgggaccgggtacctaaggttccgtaccgtcctacgtcgacgaccaggctcgtccccgtcgtcacttctcctcccacccttcctcgaccncgtaccgagtaccgtggtacgcggacgtggaccgagggtcacgtacgngnnnnnnnnnnnn

SEQ ID NO: 149486 - DNA, 591 bp, Homo sapiens
  misc_feature: GYAE6OF02I6AEL.8.73.G07.1.454.CMB.1.raw
  modified_base (157)..(157): a, c, t, g, unknown or other
  misc_feature (157)..(157): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(591): a, c, t, g, unknown or other
  misc_feature (581)..(591): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttangatgttcattggtaccgcctaggttccaggcacacgcccccagacctcctacagttaatgaataaacaacaactccggaccctcgagggtctctcgaccgtattctactcgccctccaagtcctacggctaccttcgtcgtccctcctggtctatactcgtggtcctaccgagggtcgaggatggagctgtatttactacgtcgaccctacgttccctagtacgaaccaacgacgtccgtgtacgttagttttcgcgttggttccgggcgggaccggtacgtaaggttcgccccgttacgtacgtccacgtccgaagtcctaccgcccgttcggtactacttcccgttcctcccacccgttcccaccgtaccaccggtccgaacgttcggacggccgtcgtcggacgacggtcacagtcncncnnnnnnnnnnn

SEQ ID NO: 149487 - DNA, 531 bp, Homo sapiens
  misc_feature: GYAE6OF02JZYZT.8.73.G07.1.454.CMB.1.raw
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (526)..(531): a, c, t, g, unknown or other
  misc_feature (526)..(531): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatccggccctcgaggggtctcgtagaccgattctctcgcctccaagtctcggcacttcgtgccctcctggtcatatcgtgtctccgagggtgaggatgaggcttgattagttctcgcctactctatcgaacacgagctgtagttacttggcttggtcggcggcgggacagttccgaccgtctacgtcacgccgtaagcctccgccctcggtcctcgttcctcccgtccctccctccgtccgaccacgtcganccgtaggacggtcggacgtcggacgacggccgacgagtacgntcncngctgnnnnnn

SEQ ID NO: 149488 - DNA, 549 bp, Homo sapiens
  misc_feature: GYAE6OF02HZWBC.8.73.G07.1.454.CMB.1.raw
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (544)..(549): a, c, t, g, unknown or other
  misc_feature (544)..(549): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcgaggggtctctgaccgattctctgcctcaagtctggcacgttctcgccctccctggtacatatctggtctccgaggtnaggntgagtctgtattattacgtcgccacttcctatcgacaacagcctagagttatttggcgttggtcggcgggtacgggactaggttcgaccgttcctacgtcgtacgacccgaagggtcctccgccccgttcggtacctcttaccttcgtcccctacccgtcctaccgactaccggacgtacgcgttgacggcggcgtcggactacggcgacgtaacgtaggctnangacncgnnnnnn

SEQ ID NO: 149489 - DNA, 608 bp, Homo sapiens
  misc_feature: GYAE6OF02I3V9H.8.73.G07.1.454.CMB.1.raw
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
  modified_base (588)..(588): a, c, t, g, unknown or other
  misc_feature (588)..(588): n is a, c, g, or t
  modified_base (599)..(599): a, c, t, g, unknown or other
  misc_feature (599)..(599): n is a, c, g, or t
  modified_base (605)..(606): a, c, t, g, unknown or other
  misc_feature (605)..(606): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctccctacaatttaatgaataaaccaacaacgtccggcccctcgaggggtcctcgtgaccgtattcctctgccctccaagtctggctacttcncgtcctcccgtggtcattatcgtggtctccgagggtgaggtatggaggtctgtatttattactgcctactctatcgaacacgcncctgtaagttagttcggcttcggttccgggcgggaccggtaccgtaaggtcgtaccgtccgtacgtcacgcccgaacggtcctacccggtccccgttacggtcctaccgttcgttacccgttccccgcccttcccgtcgaccgaccgcggacgtcgtacggtacggccgggtacgtcgggaccgacgggtcgacgtacggttacgcgacncgacgctcgcngcgtcnncg

SEQ ID NO: 149490 - DNA, 674 bp, Homo sapiens
  misc_feature: GYAE6OF02IHR5Y.8.73.G07.1.454.CMB.1.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (660)..(660): a, c, t, g, unknown or other
  misc_feature (660)..(660): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(674): a, c, t, g, unknown or other
  misc_feature (673)..(674): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaangataacaacaatcgccctnagggtctcngaccgattctctcgcctccaagtctggccacttctcgcctccctggtcaatactcgtggtcctccgagggtgaggtactgaggtctgtatttacgttactcgacctacttcctattcgaaccaaacgcgtccgtagtagttacgtttcggcgtttcggttaccgggcgggtacccgggtaaccgtaacggtttaccggtaaccccgtttcccgtaaccgtcccggtaaccggaccccgtaaacgggtcccgttccccgggtccccccggttacggtacccgttaaccccgtttcccgttaccccgtttacccccctacccccgttcccgttacccggacccgacccgtaccggtaacgtccgttacggaaccgggtcgggtccgtcgggaccgaacgggtccgacgtctaccgcgcagngtcgcnncncncnn

SEQ ID NO: 149491 - DNA, 705 bp, Homo sapiens
  misc_feature: GYAE6OF02IZCR5.8.73.G07.1.454.CMB.1.raw
  modified_base (336)..(336): a, c, t, g, unknown or other
  misc_feature (336)..(336): n is a, c, g, or t
  modified_base (685)..(685): a, c, t, g, unknown or other
  misc_feature (685)..(685): n is a, c, g, or t
  modified_base (701)..(702): a, c, t, g, unknown or other
  misc_feature (701)..(702): n is a, c, g, or t
  modified_base (704)..(704): a, c, t, g, unknown or other
  misc_feature (704)..(704): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataaacaacaatcggcctcgaggggtctctcgaccgattctctcgcctccaagtctggctacttctcgccctccctggtcatatctggtctccgagggtgaggtatgaggcttgtattattacncgacctaactcctaatgaacctaacgacgtaccgttggtaacgtttagttttcggcgttcgggttcggggaccgggtaccggggtaaaccgtaaacgggtttaccggaaaccccgggttttcccgttaaccggtaccgtaacggtaccccgtaaacgggtcccgttcccggtaccccccgttcgggtaccctacccgttccgttacccgttaccccctaccccgttcccgtacccgtaacccgacccggtaccgggtacgtaccgttacgggaaccgggtccggggtaccgttacgggggaacccgaacggggacccggtaaccgtaacggttaacggcgtacgtacgngacgtcgacgtacgcnncnc

SEQ ID NO: 149492 - DNA, 603 bp, Homo sapiens
  misc_feature: GYAE6OF02HWLZX.8.73.G07.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (598)..(599): a, c, t, g, unknown or other
  misc_feature (598)..(599): n is a, c, g, or t
  modified_base (601)..(603): a, c, t, g, unknown or other
  misc_feature (601)..(603): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatntcgtgtctcgagggtgaggntgaggctgtattattactcgcctactcctatcgaaccaacgtacgcttagtagttacgtttggcttggttcgggcgggtaccgggaaccgtaaggttcggacccgttcctaccgtacgacgacccgaaggtcctcccggtcccccgttcggtaccctaccgttcccttcccggtttcccccctaccccgttccctacccggtaaccacccggacgtaccgtccgttacggaccgggtccgggtccggtacgggaccgtacgggccgacgtaagtacggnancgnctcgcnncnnn

SEQ ID NO: 149493 - DNA, 544 bp, Homo sapiens
  misc_feature: GYAE6OF02FUPKE.8.73.G07.1.454.CMB.1.raw
  modified_base (252)..(252): a, c, t, g, unknown or other
  misc_feature (252)..(252): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
tcagctcgcgtgtccacgaccggtgctcgattagctctacgctcagggtcctgggcccagtctgtactgacgcagccgccctcagtatctggggccccagggcagagggtctccatctcctgcactgtagcagaaccagcatcggggcaggttatgatgttcattggtaccgccaggttccaggcacagcccccagactcctcattaatgactaacaccatccggcccctcaggggtctctgacccgattcnctgcctccagtctggcacttctgccctccctggtcatatctgtctcgaggtgaggatgagctgattacttactgccactcctatcgacaacagcctgagtatttcgggcttcggtcggcggccgggacctacgtcgtaccgtcctacgtcacgcccgaacggcctcgcccccgttcggtccactcctcgttccccgcccctcctccgaccaccggccgacgcgttcggacgtccggggctcgggaccgaacgggccgaccgaacgtacggactcacgnacgcncnncncnnc

SEQ ID NO: 149494 - DNA, 651 bp, Homo sapiens
  misc_feature: GYAE6OF02G3HTG.8.73.G07.1.454.CMB.1.raw
  modified_base (360)..(360): a, c, t, g, unknown or other
  misc_feature (360)..(360): n is a, c, g, or t
  modified_base (646)..(646): a, c, t, g, unknown or other
  misc_feature (646)..(646): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccagactcctcattaatgataacaacaatcggccctcaggggtctcgtgaccgattctctgcctcaagtctggcattctgcctcctggtcatatctggtcctccgagggtcgaggatggaggtctgtaacgtttattactcgccaaccttcctagtacgactaaacncgtacctggagttaagttttggcttcggttacgggccgggtacgggaccgtaagttacgtacccggtaccctacggttcgaacgacccgtaacgggccgtaccggtccccgttcgggtaccttaaccgtccgttccgttccccgaccccgttcccgttacccggaaccggtacccgaccggtaacgtcccggttacggtaaccgggccgggtccgttacggggcccggaaacgggcccggttaccgaaacggtttaccggaacgtcgacgaccggcgcgcgacgcngtgcg

SEQ ID NO: 149495 - DNA, 669 bp, Homo sapiens
  misc_feature: GYAE6OF02HPG8H.8.73.G07.1.454.CMB.1.raw
  modified_base (305)..(305): a, c, t, g, unknown or other
  misc_feature (305)..(305): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(662): a, c, t, g, unknown or other
  misc_feature (660)..(662): n is a, c, g, or t
  modified_base (664)..(664): a, c, t, g, unknown or other
  misc_feature (664)..(664): n is a, c, g, or t
  modified_base (666)..(668): a, c, t, g, unknown or other
  misc_feature (666)..(668): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacagcccccagactcctcattaatgataacaacaatcggcctcaggggtctctgacgattctctgcctcaagtctggctacttctgcctccctggtccatactctggtctccgagggtnaggatggacggctacgatttattactcgacctactaccctagtacgaacaacgacgtcctaggtacgttaagttttcgggcgttacgggtttcgggccgggtaccgggggtaaccgtaaacggtttacggaaccccgttttcccggtacggttacccgaacggtaccccggtaaacgggtcccgttacccggtccccccgttacgggtttaccctaacccgtttccggtttccccgtttacccccggtcccccttacccgttacccggtaacccgacccgggaccgtacggcgttacgggacgggtccgggtccgtcggggaccgacgggtcgaccgtacgtacggcncgncncnnncncnnnc

SEQ ID NO: 149496 - DNA, 587 bp, Homo sapiens
  misc_feature: GYAE6OF02GR36O.8.73.G07.1.454.CMB.1.raw
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
tcagctcgcgtgtccacgaccggtgctcgatttagctctacgctcagggtccgtgggcccagtctgtactgacgcagccgccctcagtatctggggccccagggcagagggtctccatctcctgcactgggagcagaaccagcagtcggggcaggttatgtatgttcattggtaccgccaggttccaggcacacgccccagactccgtcagttaactgaactaacaacaagtcggccctacgagggtctctgacgtatctctgcctccaagtctggcacttctgcctcctggtcatatcgtggtcctaccggtagggtacgaggaacttgggaacggtcttaggtaactttattaacgtgaccctactaccgtaattacgaactaatacgtctagtattaacgtttgacgttggtccggcgggtaccgggtacaacgtttcgaccgttactacgtcaacgacccaaggcctaccgccccgtagtccaacgttctacgtcccaaccctgtacgactacgcaagtctgacgcggtcgtagacgaggcgcgaagtaagnaacgntacgcgtaagcagtacncggtanacg

SEQ ID NO: 149497 - DNA, 522 bp, Homo sapiens
  misc_feature: GYAE6OF02H8YIR.8.73.G07.1.454.CMB.1.raw
  modified_base (334)..(334): a, c, t, g, unknown or other
  misc_feature (334)..(334): n is a, c, g, or t
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (517)..(522): a, c, t, g, unknown or other
  misc_feature (517)..(522): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgacgtattctctgcctccaagtctggcacttctgcctccctggtccatatctggttcctccgaggggttcaggatgaggctgtatttattacngccactcctatcgacacagcctagtagttatttggcttggttcggcgggcgggacctaaggttcgaccgttctacgtcagccccaaggctcgccccctggtccacttcctgtccccaccctcctccgacgtcncgagctagacggcggcgttggaccgtaggcgacgatacggcatnatncgnnnnnn

SEQ ID NO: 149498 - DNA, 519 bp, Homo sapiens
  misc_feature: GYAE6OF02HIW24.8.73.G07.1.454.CMB.1.raw
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (469)..(469): a, c, t, g, unknown or other
  misc_feature (469)..(469): n is a, c, g, or t
  modified_base (508)..(510): a, c, t, g, unknown or other
  misc_feature (508)..(510): n is a, c, g, or t
  modified_base (512)..(519): a, c, t, g, unknown or other
  misc_feature (512)..(519): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctccctggtcatatctggtctccgagggtnaggatgaggctgatttattacngcccactcctatcgaactaacagtcctgagttatttggcttggttcgggcggcgggaccaagttcgaccgtcctacgtcacgcccgaaggcctcgcccccgttcggtccaccttcgtcgttccccgcccttcctcgaccnccgcgacgcgtgacggcgggctggcgaggcgacagtagnnngnnnnnnnn

SEQ ID NO: 149499 - DNA, 663 bp, Homo sapiens
  misc_feature: GYAE6OF02IOZY4.8.73.G07.1.454.CMB.1.raw
  modified_base (648)..(648): a, c, t, g, unknown or other
  misc_feature (648)..(648): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (656)..(658): a, c, t, g, unknown or other
  misc_feature (656)..(658): n is a, c, g, or t
  modified_base (660)..(660): a, c, t, g, unknown or other
  misc_feature (660)..(660): n is a, c, g, or t
  modified_base (662)..(663): a, c, t, g, unknown or other
  misc_feature (662)..(663): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgaataaacaacaatccggccctcgacggggtctctcgaccgtattctctcgcctccaagtctggctacttctgccctcctgtcatatcgtggtctcgaggtgaggatgagtctgtattacttacgcgacctaccttccgtagtacgaactaacacgtcccgtaggttaacgtttacgtttcggtacggtttcggggttccgggacccgggaccggggtaaaccgtaacggtttacccggtaaccccgtttacccggttacccggtacgtaacccggacccgtaaacgggtccctcccgggtacccccgttcggttaccctaccgtttccgttcccgttccccgaccccttccgtaccggtaccgcccggacggtacgtccgttacggacgggccgggtccacgggtacccgacggcccgtaacggacgtaggctancgcncncnnncncnn

SEQ ID NO: 149500 - DNA, 640 bp, Homo sapiens
  misc_feature: GYAE6OF02IR68S.8.73.G07.1.454.CMB.1.raw
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (634)..(635): a, c, t, g, unknown or other
  misc_feature (634)..(635): n is a, c, g, or t
  modified_base (637)..(640): a, c, t, g, unknown or other
  misc_feature (637)..(640): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcaatttaatgaataaacaaacaatccggccctcgaggggtctctgaccgattctctgcctccaagtctggctacttcncncctcctgtcatatctgtctcgagggtgagntgaggctgtattatactgcctactctatacgaacaacacgcctaggtacgtttacgtttggtcttcgggttaccgggcgggtaccggggtaacttaaacgggtttaccgaccccgttaccgttaaccggtccaaccggtaccccgaacgggtcccctacccggtccccccgttacggtaccctacccgtttaccgttcccggtttaccccccgcccgttacccgttacccggaacccgaccggtcccgaacggtccgttaacgggacgggtccgggaccgtcgggaacgacgggcctacgtaatacggnctagntgcnncnnnn

SEQ ID NO: 149501 - DNA, 678 bp, Homo sapiens
  misc_feature: GYAE6OF02ISQF1.8.73.G07.1.454.CMB.1.raw
  modified_base (313)..(313): a, c, t, g, unknown or other
  misc_feature (313)..(313): n is a, c, g, or t
  modified_base (659)..(659): a, c, t, g, unknown or other
  misc_feature (659)..(659): n is a, c, g, or t
  modified_base (667)..(667): a, c, t, g, unknown or other
  misc_feature (667)..(667): n is a, c, g, or t
  modified_base (671)..(671): a, c, t, g, unknown or other
  misc_feature (671)..(671): n is a, c, g, or t
  modified_base (676)..(678): a, c, t, g, unknown or other
  misc_feature (676)..(678): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaatgaataaacaacaatcgccctcagggtctctcgaccattctctgcctaccaagtctggcacttctcgcctcctgtcatatcgtcgtctacggaggtgagtagngacgtcgtagtattactactcgacctactacgtaacgtagaacctaacgacgtccgtaagttacgtttagttcggttaccggtttacgggttcccgggaccggggtaccggggtaaaccgttaaacggtttaccggtaaccccggttacccgtaacgtaccggtaccggaacccggtaacgggtcccgtaccccggtccccgttaccggtacccgtaccctttaccgtttccccggttaacccccttaccccgttacccgtacccggtaaccgtaccggaccggtaacgtcgtacgggtacggggccggtccggtacggacggtacggcgtaacgtaagtaaccgngactgctnccgncacgnnn

SEQ ID NO: 149502 - DNA, 567 bp, Homo sapiens
  misc_feature: GYAE6OF02GVU91.8.73.G07.1.454.CMB.1.raw
  modified_base (285)..(286): a, c, t, g, unknown or other
  misc_feature (285)..(286): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (557)..(558): a, c, t, g, unknown or other
  misc_feature (557)..(558): n is a, c, g, or t
  modified_base (562)..(563): a, c, t, g, unknown or other
  misc_feature (562)..(563): n is a, c, g, or t
  modified_base (565)..(566): a, c, t, g, unknown or other
  misc_feature (565)..(566): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcgggggcaggttatgatgttcagttggtacccgccaggttccaggcacacgcccccagacctcctcattaatgaataacaacaactcggccctcgaggggtctctgaccgtattctctcgcctcaagtctggctacttcnnccctcctgtcatatctggtctcgagggtgaggntggagtctgtattactactgcctacttacctatcgaacaacngtaccgtagtagttactttggtcgtggttccgggcgggacgggacctaaggttcgaccttccgtaacgtcgacgcccgaggcctccgcccgttcggtcctaccttccttccgttccccacccgttcnccgacnccggcgcgtcgtgacggccggtcgtcggaccgtaggccgtacgtaagtacgcgnacgngtacnncgcnncnnc

SEQ ID NO: 149503 - DNA, 554 bp, Homo sapiens
  misc_feature: GYAE6OF02FMOV5.8.73.G07.1.454.CMB.1.raw
  modified_base (541)..(541): a, c, t, g, unknown or other
  misc_feature (541)..(541): n is a, c, g, or t
  modified_base (544)..(546): a, c, t, g, unknown or other
  misc_feature (544)..(546): n is a, c, g, or t
  modified_base (549)..(554): a, c, t, g, unknown or other
  misc_feature (549)..(554): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctcgccctccctggtcatatctggtcctccgaggtgaggatgaggctgtattattactgcctactcctatgacaacagcctgagttagtttggcttggttcggcgggtcgggaacctaaggttcgaccgttacctacgtccgacgcccgtaggcctccgtcccccgttcggtctaccgttcctccgttcccctaccccttcctccgaccgtaccgcgtacgccgtcgaacggccgggcgtacgggacgtacgggcgtaccgtgtacgntgnnncgnnnnnn

SEQ ID NO: 149504 - DNA, 660 bp, Homo sapiens
  misc_feature: GYAE6OF02G2F09.8.73.G07.1.454.CMB.1.raw
  modified_base (355)..(355): a, c, t, g, unknown or other
  misc_feature (355)..(355): n is a, c, g, or t
  modified_base (641)..(641): a, c, t, g, unknown or other
  misc_feature (641)..(641): n is a, c, g, or t
  modified_base (646)..(646): a, c, t, g, unknown or other
  misc_feature (646)..(646): n is a, c, g, or t
  modified_base (653)..(653): a, c, t, g, unknown or other
  misc_feature (653)..(653): n is a, c, g, or t
  modified_base (657)..(658): a, c, t, g, unknown or other
  misc_feature (657)..(658): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaatgaataaacaacaatccggccctcgaggggtctctcgaccgtattctctcgcctcaagttctggctacttctgtccccttcccgtggtcatactcgttcggtcctccgtagggtgacggagtgacgtcgtgtagttattacgtcnccgtacctaccgtactagtacaactaacgtacgtcgtaagttaacgtttagttcggtcgttcgggtccggggaccgggtaccggtaacggttacggtacccggtacccgttaccgttaccggtacaccggacccgtacggtcccgtcccgttccccggtacgtcctacccgttccgttaccccgtcccctccccgttccggaaccctacggacccggtacggaccgtggtaaccgggccgggtcggaccggtacggtacggaccggtaccgtacgtacgtacggcncgtancgcacgnctcnncg

SEQ ID NO: 149505 - DNA, 493 bp, Homo sapiens
  misc_feature: GYAE6OF02GR5SI.8.73.G07.1.454.CMB.1.raw
  modified_base (326)..(326): a, c, t, g, unknown or other
  misc_feature (326)..(326): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (484)..(493): a, c, t, g, unknown or other
  misc_feature (484)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcgggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccgaggtgaggatgaggctgattattacngccactcctatgacaacagcctgagtattggctgttcggcggcgggacctaagtcgaccgtcctacgtcacgcccgaaggcctcgcccccgttcggtcacttctcgttcccaccctcctcgaccacgcgagctgagcgggtcnggcaggcgngatagnnnnnnnnnn

SEQ ID NO: 149506 - DNA, 730 bp, Homo sapiens
  misc_feature: GYAE6OF02F9ZWC.8.73.G07.1.454.CMB.1.raw
  modified_base (329)..(329): a, c, t, g, unknown or other
  misc_feature (329)..(329): n is a, c, g, or t
  modified_base (721)..(721): a, c, t, g, unknown or other
  misc_feature (721)..(721): n is a, c, g, or t
  modified_base (726)..(726): a, c, t, g, unknown or other
  misc_feature (726)..(726): n is a, c, g, or t
  modified_base (729)..(729): a, c, t, g, unknown or other
  misc_feature (729)..(729): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataaacaacaatccggccctcgaggggtctctgaccgtattcctctcgccctaccaagtctggcctacttcctcgcccttccctggtcatactcgtcggtctccgaggtgaggntgaggctgtattacttacgtcgacctacctctacgtacgaaacctaaacgacggtaccttaggtaacggtttaacgtttttcggggtccgtttcggggttttacccggggccggggttacccggggggtaaacccgttaaaacggtttcccgggtaaccccggttaccccgtttaccggtacccgtaaccggaccccggtaaacgggtcccgtacccggtccccccggttaccgggtacccttaaccgttccgttcccggttaccccctaccccgttcccgttaccgaacccgtacccggaccgtacgtccgttagggaccggtaccggggtccgtacgggaccggacgggacccgtacggtaacgttaacgggcctacgacgacgtcgcgngcgcncgnc

SEQ ID NO: 149507 - DNA, 531 bp, Homo sapiens
  misc_feature: GYAE6OF02GM4QB.8.73.G07.1.454.CMB.1.raw
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (520)..(522): a, c, t, g, unknown or other
  misc_feature (520)..(522): n is a, c, g, or t
  modified_base (524)..(531): a, c, t, g, unknown or other
  misc_feature (524)..(531): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctccaagtctggcacttctgcctccctggtcatatctggtctccgagggtgaggntgnggctgattattactgccactcctatcgacaacncgcctgagttatttggcttggttcggcggccgggacctaagttcgaccgtcctacgtcacgaccaacggctccgtcccccgtcggtcctaccgtcctccgttcccctacccgtccctccgaccaccgccgacgcgtgacggcgggcgtcgggcgacgggccgcgaagtacgcnnngnnnnnnnn

SEQ ID NO: 149508 - DNA, 586 bp, Homo sapiens
  misc_feature: GYAE6OF02JZ1DH.8.73.G07.1.454.CMB.1.raw
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
tcagctcgcgtgtccacgaccggtgctcgatttagctctacgctcagggtcctgggcccagtctgtactgacgcagccgccctcagtatctggggccccagggccaggagggtctccgatctcctgcactggagcagaaccagcatcggggcagggttatggatgttcattgtaccgcaggttccaggcacagcccccagacctcctcattaangaactaacaactaactccgacctcgacgggtctacgtgaccgtattcctctcgcctccaagtcctggccacttctcgtcctcctggtcatnctgtcncaggtgagntaggagtntagtatattacngtacncgtcctancgtaaccanacgcttgacttagttcgcgttggtcgnggtcggaaccgtagttacgaccgttacggtacctacgccgaccgaccgtctcccgcccgttccgtccgtaccctccgttcccgtacccgccccttaccgtcccgaccacccgtacgtaccggcgtacgtacgggccggtacgtacgggaccgacggtccgaccgtaacggtcgatcgatacgtcncgnacgncctnc

SEQ ID NO: 149509 - DNA, 493 bp, Homo sapiens
  misc_feature: GYAE6OF02F6CSM.8.73.G07.1.454.CMB.1.raw
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (484)..(493): a, c, t, g, unknown or other
  misc_feature (484)..(493): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtcctccgagggttgaggatggaggctgatttattactgccagtcatatgacagcagcctgtagtatttggcttgtcggcgggcggacctaagtcgaccgtcctacgtcacgcccgaggctcgcccctcgcnctctcgtcccnccctcctcgacaccgcgagctgacgcgggctggacgaggcgacatcgnnnnnnnnnn

SEQ ID NO: 149510 - DNA, 844 bp, Homo sapiens
  misc_feature: GYAE6OF02HEGVC.8.73.G07.1.454.CMB.1.raw
  modified_base (157)..(157): a, c, t, g, unknown or other
  misc_feature (157)..(157): n is a, c, g, or t
  modified_base (826)..(826): a, c, t, g, unknown or other
  misc_feature (826)..(826): n is a, c, g, or t
  modified_base (839)..(839): a, c, t, g, unknown or other
  misc_feature (839)..(839): n is a, c, g, or t
tcagctcgcgtgtccacgaccggtgctcgatttagctctacgctcagggtcctgggcccagtctgtactgacgcagccgccctcagtatctggggccccagggccaggagggtctccatctcctgcactgggagcagaccagcatcgggcaggttangatgttcattggaccgctaggttccaggcacacgccccagacctcctcattaatgaataaacaactaatcggacctacgacggggtctcgtgaccgtattctcttcgccgtacaacgttctaggtctacgttcctgcccttccgtacggtccaattactcttcggtcctaccggtagggttgaaggtacgttggacggtaccgttggtaaactttacgttttaacgtcggtaccctaaccgttccttaacgttacggaaacctaaaacgtacggacccttagggttaacggtttaacgttttacgggtccggtttacgggtttaccggggcccgggggtaacggggggttaacccgaaacggggtttttcccgggaaaccccgggttttaccccggttaaaccggtttaccccggaaacggacccccgtaaaaacgggggtaccccgttccccggtaaccccccgggtttaccggggttccccttaaacccgtttcccggttttacccggtttaccccccggccccttttacccgtttaccccgggaaccgtaccccggtcccgggtaaaccgttacccggttacgggaaccgggttccggggccgggtttaaccgggaccgttaaccgggggcccggtaccgtaacgttaaacgggcaaccgttcggngcgcgacgacacncgtgc

SEQ ID NO: 149511 - DNA, 645 bp, Homo sapiens
  misc_feature: GYAE6OF02H2SD1.8.73.G07.1.454.CMB.1.raw
  modified_base (135)..(135): a, c, t, g, unknown or other
  misc_feature (135)..(135): n is a, c, g, or t
  modified_base (190)..(190): a, c, t, g, unknown or other
  misc_feature (190)..(190): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (626)..(626): a, c, t, g, unknown or other
  misc_feature (626)..(626): n is a, c, g, or t
  modified_base (636)..(636): a, c, t, g, unknown or other
  misc_feature (636)..(636): n is a, c, g, or t
  modified_base (644)..(644): a, c, t, g, unknown or other
  misc_feature (644)..(644): n is a, c, g, or t
tcagctcgcgtgtccacgaccggtgctcgatttagctctacgctcagggtcctgggcccagtctgtactgacgcagccgccctcagtatctggggccccagggccaggagggtctccgatctcctgcactgggancagaaccagcatcgggcaggttatgatgttcattggaccgcaggttccaggcacngccccagacctctcattaatgaataacacaatcgcctaggngggtctntgtaccgattctctnccctcaaggttctggtcacttcgtcgcccttcctggttcctancttatcggttcctcgtagggtnaggagtgaggctgtacgttatcgtancctacgtcctaagtcaacaactaggtcctaagaacgttagttttcgggcgtttgtcgggtccgggagggtacgtaacggttcggaacccgtttacggtaaccgttcgtaacgtcccggaaacgtcccgttccgaccccggttccgttacctagtcccgtttaccgtccctaccccggtttccgtaacccggtccctaccgggtcccggtccgtcgggtaaaccgtccggggttcgaccgggttaccgagggacccgtccggtaagtccggcgtacgcgttcngtcgcggtanctcacgtnc

SEQ ID NO: 149512 - DNA, 751 bp, Homo sapiens
  misc_feature: GYAE6OF02I6UPB.8.73.G07.1.454.CMB.1.raw
  modified_base (191)..(191): a, c, t, g, unknown or other
  misc_feature (191)..(191): n is a, c, g, or t
  modified_base (728)..(728): a, c, t, g, unknown or other
  misc_feature (728)..(728): n is a, c, g, or t
  modified_base (735)..(735): a, c, t, g, unknown or other
  misc_feature (735)..(735): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
  modified_base (747)..(748): a, c, t, g, unknown or other
  misc_feature (747)..(748): n is a, c, g, or t
  modified_base (750)..(750): a, c, t, g, unknown or other
  misc_feature (750)..(750): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaaccgccaggttccaggcacncgccccagactcctcattaatgataacaacaactccgccctcgacggggtctctcgaccgattcctctgtccctacctaacgttctcggcctacctttccgtcgtccccttccccgtgggttactattacttccgtggttccgttccggtaacgggggttaggaagggtagttggaaggtccgttagttaactttacgtttaaccgtcgtccctaaccgttccttaattacgaaccgtaaaccaacggtcctaaggttaagtttagtttcggtcgttacgggtttccggggcccgggacggggtaacctaacgggttccggaacccgttcccgacggttcccaacgaccccggaacggtccgtaccccgggtccccgtttaccgggtccctacccgttccggtttcccggtttaccccccccgtcccctttacccggtaccgtaacccccgtacgggtacccggacggtacccggttcgggaacgggtccggggttcccgaggtacccgggagggccccgtacgtaaggtaaccggngtaccgngagcgcngncgnngng

SEQ ID NO: 149513 - DNA, 620 bp, Homo sapiens
  misc_feature: GYAE6OF02FQSP3.8.73.G07.1.454.CMB.1.raw
  modified_base (605)..(605): a, c, t, g, unknown or other
  misc_feature (605)..(605): n is a, c, g, or t
  modified_base (607)..(609): a, c, t, g, unknown or other
  misc_feature (607)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (618)..(620): a, c, t, g, unknown or other
  misc_feature (618)..(620): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattatgaataaacaacaatccggccctgagggtctctgaccgattctctcgcctccaagtctgctacttctcgccttcctggtcattatcgtcggtctccgagggtcgaggagtggaggtctagtatttattacgtcgcctacctctagtgaaccaacgacgccttgtaagtttacgtttcgggtcgttcggtttcgggccgggacgggaccgttaacggtcggtaccccgttctaccggtacgccgtacccgaacgggtcccgtcccgtcccccgtttccggtaccttacccgttccgttcccgtttacccccaccccgtttacccgtcccggaaccgacccgggtccgtacgtacgcgggtacggccgggtcgtccggacgacggcgacgtgtagncnnncngngnngnnn

SEQ ID NO: 149514 - DNA, 665 bp, Homo sapiens
  misc_feature: GYAE6OF02FYK0U.8.73.G07.1.454.CMB.1.raw
  modified_base (132)..(132): a, c, t, g, unknown or other
  misc_feature (132)..(132): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggancagaaccagcagtcggggcaggttatgatgttcattcggtaccgccaaggttccaggcacacgcccccagacctcctacacttaatgaataaacaacaatccggcctcgagggtctcgtcgaccgtattctctcncctccaagtctggctacttcncgtccctccgtgtctatatcgttggtcctccggaggtggaggtagtggagtcttagtatttagttacncgtaccgacttacctagtacgaactaacgacgtcgttcgtaagtttcttacgggtcgtacggttcgggaccgggtccggggaaactacggttaccggtacccgttacccgtacggtaccgaccggtacccgaacggttcccgtaccgtcccccgttacggcctacccgtttcccgttcccgttaccccctaccccgttcccgttacccgaaccgtaccggaccggtaccggtccgtaggaacccgggtcggccgtacgggtacggtaacggccggtctaagtacgctagacgcatgtcngtagacngcg

SEQ ID NO: 149515 - DNA, 546 bp, Homo sapiens
  misc_feature: GYAE6OF02H9XCA.8.73.G07.1.454.CMB.1.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (523)..(523): a, c, t, g, unknown or other
  misc_feature (523)..(523): n is a, c, g, or t
  modified_base (536)..(537): a, c, t, g, unknown or other
  misc_feature (536)..(537): n is a, c, g, or t
  modified_base (541)..(541): a, c, t, g, unknown or other
  misc_feature (541)..(541): n is a, c, g, or t
  modified_base (544)..(545): a, c, t, g, unknown or other
  misc_feature (544)..(545): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactggggagcagaaccagcatcggggcaggttatgatgttcattggtaccgccaggttccaggcacagcccccagacctcctcattaatgaataaacaaacaatccggccctacgaggggtcctctcgaaccgatttctctgccctacctaagtctggcctactttctgtccctcccgtggtcatactcgtgtctcgaggtgagntgagtcngtattatacgcgccactcctnacacacngctgtattatttggttgtcggcggcggactagtcgaccgtctacgcacgacctaggcctcgccccgtcgtctacctcgtccgttacccgccctacctcgaacccgacgcgacgtcgtcggacgccgggtcacgggcgaacgggccgacgtaagtacggntactccgatgacnncgcnctnnc

SEQ ID NO: 149516 - DNA, 625 bp, Homo sapiens
  misc_feature: GYAE6OF02G8ZV5.8.73.G07.1.454.CMB.1.raw
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacgacgcccccagactcctcattaatgataaacaacaatcggccctcaggggtctctgaccgattctctcgcctccaagtctggcctacttctcgcctcccgtggtcattatctggtcctccgagggtgacggtatggaggtctgattattactgccactcctagtnaccgaacacggccttggtaagttagtttcgggacttcggttacccggnggggtacccggggtaaccaaagggtttcgaccccgttaccctacggttcaaccgtcccaaagggtccctaccgtcccccgttcggtcctaaccgttcctccgttcccccggtccccttcccgttaccggacctaccggacgtaacggccgttagggaccggcgggtccgtacgggcgaacgggtccgaaccgtaggttacggcncgcgancncnncncncnnc

SEQ ID NO: 149517 - DNA, 532 bp, Homo sapiens
  misc_feature: GYAE6OF02F3XCQ.8.73.G07.1.454.CMB.1.raw
  modified_base (475)..(475): a, c, t, g, unknown or other
  misc_feature (475)..(475): n is a, c, g, or t
  modified_base (518)..(518): a, c, t, g, unknown or other
  misc_feature (518)..(518): n is a, c, g, or t
  modified_base (521)..(523): a, c, t, g, unknown or other
  misc_feature (521)..(523): n is a, c, g, or t
  modified_base (525)..(532): a, c, t, g, unknown or other
  misc_feature (525)..(532): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatggaggctagattattactgccactacctatgacaacagtccgtgagttgtttggcttaggttcggccgggtcgggaccgtaacgttcgtaccgtcctacgtcacgcccgaaggcctccgcccccttcggtcctactccgttcgttccccgccctccctccgacnccggacgagcgaggccgggtcgtcggacacggcgacacgtagncgnnngnnnnnnnn

SEQ ID NO: 149518 - DNA, 636 bp, Homo sapiens
  misc_feature: GYAE6OF02HGM3V.8.73.G07.1.454.CMB.1.raw
  modified_base (616)..(616): a, c, t, g, unknown or other
  misc_feature (616)..(616): n is a, c, g, or t
  modified_base (635)..(635): a, c, t, g, unknown or other
  misc_feature (635)..(635): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacacgccccagactcctcattaatgataacaacaatcggccctcgaggggtcctcgtcgaccgtattctctgtcctccaagtctggctacttctgccctccctggtcatatcgtgtcctccgagggtgagggatggacggctgtattaattactgccactcctatcgaacaacacgccgtgtagttagtttcggcgtcggttcgggcggtaccgggactaacggttcgaccgttacctacgtacacgacccgaagtccgtaccgcccccgttcggtacctaccgttccgttaccgtttccccctaccccgttcccgtacccggtaacccgtacccgggcccggtacggtcccgttacgggtaaccggggtccgggtcggttacgggacccggtaacgggtccggaaccgtacgtacggactcacggtacncgtcgcgtctacgtcgcgng

SEQ ID NO: 149519 - DNA, 698 bp, Homo sapiens
  misc_feature: GYAE6OF02GBM2A.8.73.G07.1.454.CMB.1.raw
  modified_base (683)..(683): a, c, t, g, unknown or other
  misc_feature (683)..(683): n is a, c, g, or t
  modified_base (688)..(688): a, c, t, g, unknown or other
  misc_feature (688)..(688): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcagttggtaccgccaggttccaggcacagcccccagactcctcattaatgataacaacaatcggccctcgaggggtctctgaccgattctctgcctcaagtctggcacttctgcctcctggtcatatcgtggtctccgagggtgaggatggagctagtactttattactcgcctactcctagtcgaaccaaacgacgcctaggtacgtttaagttttcgggcgtttaggttccggggcggggtaccgggggtaacccgtaaacggtttccggtaaccccggttacccgttaaccggttaccaaccggaccccgtaaacgggtcccgtacccggtcccccccggttacgggttaccctaccgtttacccgttcccggtttccccccgtacccccgtttcccgttacccggaacccgtacccgggtaccgaacggtcccgttagggaaccgggtccggggtaccgtacgggaccggtaacgggcccggtaaccgtaacgttaacggcgtcgacgtcggaccncgacncgacgcgagc

SEQ ID NO: 149520 - DNA, 711 bp, Homo sapiens
  misc_feature: GYAE6OF02HD5SJ.8.73.G07.1.454.CMB.1.raw
  modified_base (693)..(693): a, c, t, g, unknown or other
  misc_feature (693)..(693): n is a, c, g, or t
  modified_base (709)..(710): a, c, t, g, unknown or other
  misc_feature (709)..(710): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgaataaacaactaatccggccctcgacggggtctcgtacgaccgtattctctcgtccctaccaagtctggctacttctcgtccctccgtgtacatactcgtcggtctccggagggtgaggtagtggaggtctagtatttacgttacctcgtaccctacttacctatacgtaaccaacgacgtcctaggtaacgtttacgtttacggtccgttacgggttccggggaccggggtaccggggtaaccgtaacgggttaccggtaaccccggttacccgttaacggtacccgtaccggaacccggtaccggtacccgtccccggtcccccggttacggttccctacccgtttcccgttccccggttcccccgtaccccgttacccgtacccggaacccggtacccggtaccggtacgtccggtacgggtccgggaccggggtcgtacgggaccggtaccggacggtacgtaagcggtcagacgntacgacgcacgtgacnnc

SEQ ID NO: 149521 - DNA, 733 bp, Homo sapiens
  misc_feature: GYAE6OF02HZCPH.8.73.G07.1.454.CMB.1.raw
  modified_base (212)..(212): a, c, t, g, unknown or other
  misc_feature (212)..(212): n is a, c, g, or t
  modified_base (473)..(473): a, c, t, g, unknown or other
  misc_feature (473)..(473): n is a, c, g, or t
  modified_base (708)..(708): a, c, t, g, unknown or other
  misc_feature (708)..(708): n is a, c, g, or t
  modified_base (722)..(722): a, c, t, g, unknown or other
  misc_feature (722)..(722): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacacgaccccagacctctacattaangaactaaacaactaacgtcggtaccctacgacggggtctactcggaacgtccgttacgtacttacggtccctaccgaaacgttccgtggtacctaccgtttcctacggtcccctacccgttacggtaccaattacgttcgtacggttaccgtaccgtagggggtaggaacggtagtcggtaacgggtaccttaaggttatttactttaacggtacgtaccccgtacttaccgtaagttccgaaacgtaaccgaacgtaccnggttaacggttagttacggtcgtttacggtccgggaccgggtacgggaaccgttaacgggtcgtaacccgttacgtaccgttacgaccgtaccgtaacggtccgttaccgtccccgtcggtacctaccgttacccgttaccggttacccctacccgttacccgtacgacccgccggtaccggacgtccgtagtccggccggtggaacgtcggaacgtcggtaacgaacgttacgngtacgagcgagacncgacactcagc

SEQ ID NO: 149522 - DNA, 503 bp, Homo sapiens
  misc_feature: GYAE6OF02I1XYM.8.73.G07.1.454.CMB.1.raw
  modified_base (312)..(312): a, c, t, g, unknown or other
  misc_feature (312)..(312): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (489)..(492): a, c, t, g, unknown or other
  misc_feature (489)..(492): n is a, c, g, or t
  modified_base (494)..(495): a, c, t, g, unknown or other
  misc_feature (494)..(495): n is a, c, g, or t
  modified_base (497)..(498): a, c, t, g, unknown or other
  misc_feature (497)..(498): n is a, c, g, or t
  modified_base (502)..(503): a, c, t, g, unknown or other
  misc_feature (502)..(503): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgataacaacaatcggccctcgaggggtctctgaccgattctctgcctccaagtctggcacttctgcctcctggtcatatctggtctccgaggggtcaggntggaggctgattattactgccactctatgacaacagcctagagttatttggcttggttcggcggcggacctaaggttcgaccgtcctacgtcacgcccgaggcctcgcccctggtcctactctcgtcccnccctctcaccncgcgcgcgtcgnggcggctggacgagcgcgtagagnnnngnngnngtcnn

SEQ ID NO: 149523 - DNA, 782 bp, Homo sapiens
  misc_feature: GYAE6OF02IN5MN.8.73.G07.1.454.CMB.1.raw
  modified_base (761)..(761): a, c, t, g, unknown or other
  misc_feature (761)..(761): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
  modified_base (769)..(771): a, c, t, g, unknown or other
  misc_feature (769)..(771): n is a, c, g, or t
  modified_base (774)..(774): a, c, t, g, unknown or other
  misc_feature (774)..(774): n is a, c, g, or t
  modified_base (777)..(777): a, c, t, g, unknown or other
  misc_feature (777)..(777): n is a, c, g, or t
  modified_base (779)..(780): a, c, t, g, unknown or other
  misc_feature (779)..(780): n is a, c, g, or t
  modified_base (782)..(782): a, c, t, g, unknown or other
  misc_feature (782)..(782): n is a, c, g, or t
tcagctcgcgtgtccacgaccggtgctcgattttagctctacgctcagggtcctgggcccagtctgtactgacgcagccgccctcagtatctggggccccagggcagagggtctccatctctgcactgggagcagaaccagcagtcggggctaggttatgtattgttactagtttcggtacccgccgtaagggttccgacggccaaccacgcccccacgaccgtccctactaagtttaaatagaataaaccaacgtaaacgtcccggaccccgtcggtacggggttcctccgttacggaccgtactttccgttccgtccggtaccccttaaccgtaacggttccgttccggtaccttacctttcccgtacgtcccccgttacccgtttagggtaccttaagtttaccttccggtttacgggtttacccgtaccggggtaagggggttacggtaacgggtaaggttcgggtaaccggtcgtttaagtttaacgttttaaccttaaccgttccgaaccccttaaccttaccgttaagtaaccggaacctaaccggaacgtccgttaaggttaacgtttcgttacggtccgttcgggtaccggggaccggtaccgggtaaccgtacggttaccgtacccgtaccgtacggtaccgaccgacccgacgccgtcccgtccccggtcgtaccctccgttcccgttcccgtccccgtccctccgtaccaccgtaccgcgacgtcgtcgtcggcggcgtgacggcgcgngtangncnnngcngcngnngn

SEQ ID NO: 149524 - DNA, 641 bp, Homo sapiens
  misc_feature: GYAE6OF02FTWTT.8.73.G07.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (629)..(629): a, c, t, g, unknown or other
  misc_feature (629)..(629): n is a, c, g, or t
  modified_base (634)..(636): a, c, t, g, unknown or other
  misc_feature (634)..(636): n is a, c, g, or t
  modified_base (640)..(641): a, c, t, g, unknown or other
  misc_feature (640)..(641): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatccggccctcgaggggtctctgaccgattctctgcctccaagtctggctacttctgtccctccgtggtctntatcgtggtctccgngggtgaggntggacgctgatttacgttactcgtccctacttccgtaatcggtaacaactagtcctaggtaagtttacgttggtccgttaggttccggggccggccggggaaccttaacggttccgtacccgttcccgttaccggtacgaccggtacccgaacgggtcctcccggtcccccgttcgggtacctacccgttccgttacccgttccccccgtcccttcccgttccggaaccgaccggtaccggacgtcggttacggaccgggtcgggtaccgtacgggaccggtacgggccgtacggtaactaggactgccgnacgcnnncacnn

SEQ ID NO: 149525 - DNA, 725 bp, Homo sapiens
  misc_feature: GYAE6OF02F2Y5J.8.73.G07.1.454.CMB.1.raw
  modified_base (706)..(706): a, c, t, g, unknown or other
  misc_feature (706)..(706): n is a, c, g, or t
  modified_base (711)..(711): a, c, t, g, unknown or other
  misc_feature (711)..(711): n is a, c, g, or t
  modified_base (713)..(713): a, c, t, g, unknown or other
  misc_feature (713)..(713): n is a, c, g, or t
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
  modified_base (720)..(725): a, c, t, g, unknown or other
  misc_feature (720)..(725): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactggggagcagaaccagcagtcggggcaggttatgtatgttctagttggtacccgccgtaggttcccaggccacaccggcccccagcctcctctaattaatgactaaaccaactaacgttcccggaccctcggtacggggttcctcgtcgaaccgtattactcctcgccctaccaagttcctacggcctactttcctcgtccccttcccgtggtctatacttcgttcggtcctccggagggtcggaggtagtcggaggtcgttgttaacttttacttacctccggtacccttaaccgttaccgtaacgttacgaacctaaccgtaccgtccgttaggttaagtttgtttcgggttccggtttgggtttcggggacccgggtacgggtaaccggttaacgggttccgtaaccccggttacctaccggttaccggaacccgtacccggaaccgggtccctccccgggtccccgttacggtcccttaccgttcccgttcccgtaccccgtccccttcccgtaccgaccggccgtcgaccggtcggcggaccggcgggtccgtacggccggacgtcgacgtacgnggacncngngtncnnnnnn

SEQ ID NO: 149526 - DNA, 587 bp, Homo sapiens
  misc_feature: GYAE6OF02HJPJ3.8.73.G07.1.454.CMB.1.raw
  modified_base (206)..(206): a, c, t, g, unknown or other
  misc_feature (206)..(206): n is a, c, g, or t
  modified_base (353)..(353): a, c, t, g, unknown or other
  misc_feature (353)..(353): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
  modified_base (582)..(584): a, c, t, g, unknown or other
  misc_feature (582)..(584): n is a, c, g, or t
  modified_base (586)..(586): a, c, t, g, unknown or other
  misc_feature (586)..(586): n is a, c, g, or t
tcagctcgcgtgtccacgaccggtgctcgatttagctctacgctcagggtccctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctnattaatgataacaacaactcggccctcgagggtctctcgaccgattctctgcctccaagtctggctacttctcgtccctcctggtacatactctgtctcgagggtgaggtatgagtctgtaattagttactcgacctacgttcctancgtaacaacacgccgtagtaacgttagtttcggtcgtttaggtcgggcgggtaccggaaccgtacggttcgaaccgttcctacgtacacgtacccacggtcctaccgccccgtcgtcctaccgttcctccgtccccgtccctaccnccggactaccgcgtaacnccgtcggacggtccgggcttaccggggcaacgggccgagtaacgacctagctgacgcgtacacgnnngnc

SEQ ID NO: 149527 - DNA, 752 bp, Homo sapiens
  misc_feature: GYAE6OF02HYT18.8.73.G07.1.454.CMB.1.raw
  modified_base (737)..(737): a, c, t, g, unknown or other
  misc_feature (737)..(737): n is a, c, g, or t
  modified_base (741)..(741): a, c, t, g, unknown or other
  misc_feature (741)..(741): n is a, c, g, or t
  modified_base (744)..(744): a, c, t, g, unknown or other
  misc_feature (744)..(744): n is a, c, g, or t
  modified_base (748)..(748): a, c, t, g, unknown or other
  misc_feature (748)..(748): n is a, c, g, or t
  modified_base (750)..(751): a, c, t, g, unknown or other
  misc_feature (750)..(751): n is a, c, g, or t
tcagctcgcgtgtccacgaccggtgctcgatttagctctacgctcagggtcctgggcccagtctgtactgacgcagccgccctcagtatctggggcccccagggcaggagggtctccatctcctgcacgtggggagcaagaaccagcagtcgggggctaggttatggattggttctagttcggtaccgccgaggttccaggcacacgcccccagacctctacattaagtgaataaacaacaagtccggaccctaggtacgggtccttcgtacggacgtacttccttcgtcgtacccttaccgtaacgttcgtgggtacctccgtttccgtcgtcccccgttccccgtggttactacgttacgttcgttccggttaccgtaccggtagggttaggacggtaggtcggaggtccttagtaactttaacgttacgtccgtaccgtaccttcctaacgtacgaaaccgtaaacggcgtacgttaggtacgttttacggtttacggtcggttcgggttccggggaccggggtaccgggtaaccggttaccggttacccggtacccggttaccgttaacgaccaccgggaacccgtacggcccgtacccgtccccggttaccgtcgtacccttccgttacccgtccctaaccccgttccgtaccgacccgtacgaccgacggtacgtcgacgggtccgggccgtacggggacgacgggtccgacggacttacgcgtataccgngcgnagngcgngnng

SEQ ID NO: 149528 - DNA, 595 bp, Homo sapiens
  misc_feature: GYAE6OF02GAFOM.8.73.G07.1.454.CMB.1.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (359)..(359): a, c, t, g, unknown or other
  misc_feature (359)..(359): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
  modified_base (586)..(586): a, c, t, g, unknown or other
  misc_feature (586)..(586): n is a, c, g, or t
  modified_base (589)..(592): a, c, t, g, unknown or other
  misc_feature (589)..(592): n is a, c, g, or t
  modified_base (594)..(595): a, c, t, g, unknown or other
  misc_feature (594)..(595): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgccccagactcctcattaatgaataacaacaatccggccctcgagggtctcngaccgtnttctctcgcctccaagtcgtaggctacttctcgccctccgtgtctatactcgttcggtccgtccgagggtcggacgtagtcggacggtcttagtaactttacgttacncgtacctaccttctaagtcaacaacgtcgtctagtacgttagtttggtccgttggttcgggacgggacgggtactaggtcgtaccgttaccgtacgtccaccggccgtaacggtccgtcccgtccccgttcggtcctaccgttcctccgtcccctccctccgtcgacctcgaccgcgcgttcggaccgcggcgtcggaccgacggtccgacgnggtacncgtgactncgnnnncnn

SEQ ID NO: 149529 - DNA, 677 bp, Homo sapiens
  misc_feature: GYAE6OF02IXZNO.8.73.G07.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (653)..(653): a, c, t, g, unknown or other
  misc_feature (653)..(653): n is a, c, g, or t
  modified_base (662)..(662): a, c, t, g, unknown or other
  misc_feature (662)..(662): n is a, c, g, or t
  modified_base (666)..(666): a, c, t, g, unknown or other
  misc_feature (666)..(666): n is a, c, g, or t
  modified_base (671)..(671): a, c, t, g, unknown or other
  misc_feature (671)..(671): n is a, c, g, or t
  modified_base (675)..(677): a, c, t, g, unknown or other
  misc_feature (675)..(677): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggctaggttatgattgttcattggtaccgccaggttccaggcaccacgcccccagacctcctacatttaatgaactaaacaacaacgtccgccctacgtacgggtctctcgaccgtattctctgcctcaagttcgnggcctacttcnctccctcctggtcattactcgtgttccgtacggngggttacgaggtagtcggacggtctagttactttacttacgtcgaccctacgttacctaaggttacgaaccaactacggtcctttaaggtcggttaacgttcggttacgttccgggtttcgggaccgggtacggaacccgtaagggtttaccgtaaccgggtcccgtaacggttcgaaccgtacccgtaacggtcccgtacccgccccggttacgttccaccgtttccttccccgttcccgcccgttacccgtccgtaacgccgtaccggacgtcgtacggaccgggtcgggcctacggggtaccgaacggctaacggacggtntacgcgtancgancgtangacnnn

SEQ ID NO: 149530 - DNA, 677 bp, Homo sapiens
  misc_feature: GYAE6OF02H7TXT.8.73.G07.1.454.CMB.1.raw
  modified_base (305)..(305): a, c, t, g, unknown or other
  misc_feature (305)..(305): n is a, c, g, or t
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
  modified_base (671)..(671): a, c, t, g, unknown or other
  misc_feature (671)..(671): n is a, c, g, or t
  modified_base (676)..(676): a, c, t, g, unknown or other
  misc_feature (676)..(676): n is a, c, g, or t
tcagctcgcgtgtccacgaccggtgctcgatttagctctacgctcagggtccgtgggcccagtctgtactgacgcagccgccctcagtatctggggccccagggcagagggtctccatctcctgcactgggagcagaccagcagtcggggcaggttatgacttgttctagttcggtaccgcctaggttccaggcaacgacgcccccagacctcctcattaatgaataacaactaactccggcctcgtagggtcctcgtacgaccgtattctcgtcgtccctaccgtaagttctcggactacttcnccgtccctaccgtgtacattactcgttggtccgtcggtagggtgacgtagtggaacgtgtagttaactttacgtacgtcgacctacttaccgtagtaccgaacacgtacgtcgtaggtactttgttacggtcgttcgggtcgggaccggtacgggtaacctaggtttaccgaccccgtttaccgtaacgttaccgacgtcccggtaacggtctccccggtacccgttcgtaacctccgttacccttcccgtaaccccgtaccctacgtaccgaacccgtcgtaaccgacgtccggtaacgggaccggtcggtaacgtcgggaacgtacccggtcaccgggtaagtacgtacgnacgngacgcgcgncgtgnc

SEQ ID NO: 149531 - DNA, 684 bp, Homo sapiens
  misc_feature: GYAE6OF02IHNPQ.8.73.G07.1.454.CMB.1.raw
  modified_base (658)..(658): a, c, t, g, unknown or other
  misc_feature (658)..(658): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
  modified_base (680)..(684): a, c, t, g, unknown or other
  misc_feature (680)..(684): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccgaggttcccaggcacacgcccccagacctcctcagttaatgaataaacaacaacgtccggcccttcgacggggttctccgtcgtaccgactttctctcgtccctaccgaagttcgtcggacctcctttccgtcgtcccttccgttcggtactaattctcgttcgggttcctaccggaggggttcgaaggtcgttaggacggtcttaacggttatttaccttacgtccgccctacttaccgtatacggaactaacgacgtccgtagtacgtttagtttcggcgtttcgggtttaccgggccgggtaccgggtaaccgtacggtttaccggaccccgttaccggtaccgtcgtaaccgtaaccccgcgggtccctacccggtcccccgttaccgtcctacccttccgttcccgtacccccggtccctccgtaccgaccgaccgcgtacgccggtaggccggcggtcgacggtacgacggtacncggtatacgntagctgnacgannnnn

SEQ ID NO: 149532 - DNA, 580 bp, Homo sapiens
  misc_feature: GYAE6OF02JH9A4.8.73.G07.1.454.CMB.1.raw
  modified_base (305)..(305): a, c, t, g, unknown or other
  misc_feature (305)..(305): n is a, c, g, or t
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtcctccagggtnaggatgaggctgtattattactgacccactccctaatgaacaacacgtcctgagttatttggcttgttcgggcggccgggaccctaaggttcgacccgttcctacgtcacgcccgaaggtcctaccggccccccgttaggtcctaccgttcgtacgtttccccccacccttccgtccgaaccaccggtcgaacgtccgtacggaaggtcccggtacgtcgggacctaacggggtccacgtaagttaccggngtcgcgtcncgacngcgcgtcntc

SEQ ID NO: 149533 - DNA, 709 bp, Homo sapiens
  misc_feature: GYAE6OF02JJWVQ.8.73.G07.1.454.CMB.1.raw
  modified_base (213)..(213): a, c, t, g, unknown or other
  misc_feature (213)..(213): n is a, c, g, or t
  modified_base (685)..(685): a, c, t, g, unknown or other
  misc_feature (685)..(685): n is a, c, g, or t
  modified_base (689)..(689): a, c, t, g, unknown or other
  misc_feature (689)..(689): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaangtataacgaacaactccggccctacgtaggggtctcgtcgaccgattcctctcgccttccgaagtctggctaccgttctacgccctcccgtaggtctactagtcgtcggtctccgagggtcgaaggtatgaggctggtaacttattaccgtcgcctacttccgtataggacctaacgtacggccttaggtagtttaacgtttcgggacgtttcggttaccggggccgggtaccggggtaacccgtaacggtttaccggaaccccgttttcccggtaaacgggttaccgaacccggaccccggtaaacgggtcccctacccgggttccccccgttaccgggtacctaccggtttcccgtcccgtttacccccctcccgttcccgtaaccggttcacccggtaccggacgtaccgtggttaaccggtcgggtccggtacgtaccgggaacggtccgtcgtaaacgtggccgtanacgngtacgtcgtcgcgctctgcg

SEQ ID NO: 149534 - DNA, 731 bp, Homo sapiens
  misc_feature: GYAE6OF02H19AC.8.73.G07.1.454.CMB.1.raw
  modified_base (701)..(701): a, c, t, g, unknown or other
  misc_feature (701)..(701): n is a, c, g, or t
  modified_base (708)..(708): a, c, t, g, unknown or other
  misc_feature (708)..(708): n is a, c, g, or t
  modified_base (729)..(731): a, c, t, g, unknown or other
  misc_feature (729)..(731): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaccagcagtcgggcaggttatgagtgttcagttggtaccgccacggttccaggcacacgcccctagacctcctcaacttatagaataacaacgaactccggtcctaggagggtcctcgtacgacgtattctctcgccctcgaacgtcgtggtacctacttcctcgtccctcccgtggtctacttacgtcgtcggtcctaccgtagggtagaacggtcgtaggtacggtacgttagttacgtttaattccgtccgaccttaccgttacccttaagtaccgtaaacgtaacgtcggtacgttacggtacggtttaagtttcggtccggtttacgggtaccggggtccgggtaaccgggtaacgtacgggttttaacccgtacccccggtttaacgtttacccggcgttaaacccgggacccggttaaccgtccggtacccccggtacccggttccggttaccctacgtttccgttaccccgttaccccaccccgtttccgaccgaaacccggtcgttaccggaccgtccggttacgggaccggggttcgacggttacggactaccggngtacganacgtcagacgtcagcgatgcnnn

SEQ ID NO: 149535 - DNA, 722 bp, Homo sapiens
  misc_feature: GYAE6OF02HGCIJ.8.73.G07.1.454.CMB.1.raw
  modified_base (707)..(707): a, c, t, g, unknown or other
  misc_feature (707)..(707): n is a, c, g, or t
  modified_base (715)..(722): a, c, t, g, unknown or other
  misc_feature (715)..(722): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagacctcctactattaatgaataaacaacaactccggccctcggtacgggtcctcgtcgacgtacttctccgtcgcccttaccgtaaggttccgtacggtcctacctttccgtacgtcccccttaccccgttggttactaattaccgttcgttcggttcctaccgggtaggggtcggaacggtagtaggtacgtcttaaggtactttactaccgtccgtaccctaaccgttaccgtaactaccgaaaccgtaaaccgtacggttacccgttagggttaaacggttttaacggtttcgggtccgggtttaccggggtttaccgggggaccggggttacccggggtaacccgttacgggttacccggtacccgtaaccggttaccgtaccgaacggacccggtacggcccgtcccgtccccgttcgtcctaccgttcgttccctcccggtccctccgacgaccgacgacgcgtacgcgacggccggcgcggacgacgccgtagtcggacgnctgacgtnnnnnnnn

SEQ ID NO: 149536 - DNA, 745 bp, Homo sapiens
  misc_feature: GYAE6OF02IDMJK.8.73.G07.1.454.CMB.1.raw
  modified_base (703)..(703): a, c, t, g, unknown or other
  misc_feature (703)..(703): n is a, c, g, or t
  modified_base (724)..(724): a, c, t, g, unknown or other
  misc_feature (724)..(724): n is a, c, g, or t
  modified_base (729)..(729): a, c, t, g, unknown or other
  misc_feature (729)..(729): n is a, c, g, or t
  modified_base (737)..(737): a, c, t, g, unknown or other
  misc_feature (737)..(737): n is a, c, g, or t
  modified_base (739)..(744): a, c, t, g, unknown or other
  misc_feature (739)..(744): n is a, c, g, or t
tcagctcgcgtgtccacgaccggtgctcgatttagctctacgctcagggtcctggcccagtctgtactgacgcagccgccctcagtatctggggcccccagggcagagggtctccatctcctgcacgtgggagcaagaaccagcagtcggggcaggttatgattgtctattcggtaccgccgtacggttccgaggcaccgaccgaccccccagacctcctactaagttaacgtagtaaacaaaacctttaaaccaaacgttcccggtacccctacgggtaacgggggttaccctcgtacggtaacccgttctttccgttccgttcgtacccctaccgtaaacggttccgtacggtccctaccgtttccgtcccgttcccgttccgttggttaacctaagttccgttaccggttcgttccctaccgggtagggtcggtaggtggtaggtaccgtgtagttaactttacgtacgtcggtaccctaacgttaccgttataacgaacctaaccgtagtccgtaaggttagtttacggttggttaccggttcgggtacgggcccgggtaacggtacctaacggtacccgtaacccgtacccgtcggtacgtaccgaccggaccgtccgtcccgtacccgtcggttctccctaccgttccctccctacccgaccgttccgaccgcgtcgagtcggtacggcgtacgggngtaagggccaacgggtcacgngtacngctagctngnnnnnng

SEQ ID NO: 149537 - DNA, 792 bp, Homo sapiens
  misc_feature: GYAE6OF02I8VPZ.8.73.G07.1.454.CMB.1.raw
  modified_base (779)..(779): a, c, t, g, unknown or other
  misc_feature (779)..(779): n is a, c, g, or t
  modified_base (790)..(790): a, c, t, g, unknown or other
  misc_feature (790)..(790): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaccagcagtcggggcaggttatgatgttcattggtaccgcctaggttccaggcacacgccccagactcctacagttaatgaataacaacaaacgtcggacccgtacgtacggggtcttcgtagaccgtatttcctctacgacccttaccgtaaaggtccgttacgggtcctaactttcctaccggtccccttaccgttggtactaactttacgttcctacgggttaccctaccggaacgggggttacgtaagggtacttcgggtaacgggtcttaggttaaactttaacgttaccgtacgtaccctaacctaccgttaactaccgtaacctaaacggacgttaccctttaagggtagtttaacgttttagggccggtttacgggtttaccgggaccggggtaaccgggtaccgttaacgggttacgtaccccgtttaccgtaccgtacccgacgtaccccggaaacgtcccgtcccggtaccccgttcgggtacctacccgtttacccgttcccgttacccctaccccgttcccgtaaccgtacccgtaccggcgtaacgtaccgttacggtaaccgggtccggtacgttaccggaacggaaccgggtaccgtacccgtaagtacggtcaacgacgtccgttaancgactcgcatnac

SEQ ID NO: 149538 - DNA, 817 bp, Homo sapiens
  misc_feature: GYAE6OF02ICXJE.8.73.G07.1.454.CMB.1.raw
  modified_base (814)..(815): a, c, t, g, unknown or other
  misc_feature (814)..(815): n is a, c, g, or t
tcagctcgcgtgtccacgaccggtgctcgatttagctctacgctcgagggtcctggcccagtctgtactgacgcagccgccctcagtatcgtcgggccccagggcagagggtctccatctcctgcacgtgggagcgagaacccagcagtcggggcaggttatggatggttccattcggtaccgcctacggttccaggcacacgacccccagtactcctcgattaatcgaataaaccaactaacgtccggccctacggacggggtcctcgtacgaaccgtattcctcttcgtacccttacgtaacgttcctacggacctaccgttacgtaccgacccccgttcccgttagggtaccctaattaccgtaccgtttcgggtttacctacccggtaaggggttaccggtaagggtagttcgggtaacgggttccggtaaggtttaacctttaagtttacccgacgacccttaacgttcccgtaagtacgaaccgaacgtacgtaccgtaggtaacgtttacgttttcgggaccggtttacggtttacccgggggaccgggttaaccgggtaaccgttaaacgggtttaccggtaccccgtttaacccggttaccgtaccggtaaaccggtacccgtaaaccgggttcccgttacccggtacccccggtttacgtcccgttaacccgttccgtttaccccgttccccggtacccgtttcccgttaccggaacccgttccgaccgtacggtccgtacgggaccggccggtacgtacggaccgaacgggctagactcgctgacgtatcgatcgactgaccnncg

SEQ ID NO: 149539 - DNA, 876 bp, Homo sapiens
  misc_feature: GYAE6OF02F8W74.8.73.G07.1.454.CMB.1.raw
  modified_base (858)..(858): a, c, t, g, unknown or other
  misc_feature (858)..(858): n is a, c, g, or t
  modified_base (866)..(866): a, c, t, g, unknown or other
  misc_feature (866)..(866): n is a, c, g, or t
  modified_base (869)..(869): a, c, t, g, unknown or other
  misc_feature (869)..(869): n is a, c, g, or t
  modified_base (873)..(874): a, c, t, g, unknown or other
  misc_feature (873)..(874): n is a, c, g, or t
tcagctcgcgtgtccacgaccggtgctcgatttagctctacgctcagggtcctgggcccagtctgtactgacgcagccgccctcagtatctgggccccagggcagagggtctccatctcctgcactgggagcagaaccagcagtcggggctagggttatgatgttctagttcggtacccgcgtaggttccaggcaccacgcccccagacctcctactaacttaatagaactaaacaaacctaacgttaccggtcccctaccggtaggggttcctaccgttcggaacccgtaatttccgtctaccgtcccttaacccgaagttccgtcggtacccttacgtttcccttccggtcccccttcccccggttacggttacctaaagtttacccgtttacccgttaccgggttccttacccgggtaagggggttaacggtaagggtaaccgttacgggtaacggtccttaacggttaaatttacgtttaaccgtccgaaccccttaaccgttacttaaccgtaactaaaacccgaacgtacggttaccgttaacggttaacggttttaggttttacggtccggtttacggggttcccgggaccggggttacccggggtaaaccgtttaaccggtaaccgtaccccggttacccgttacggtaccgtaccgtaacccggtacggtccccgtccccggtacccccggttccggttaccctacctttacccggttccccgtttaccccctaccccgtttacccgaccgtaacccgtaccgggtaaccgtccggtaccggtacgggtacccgggtccggtacggttaccggacggggtacgtaaccggacgtaccgtaagctaccgntacgcgcnctnactnntg

SEQ ID NO: 149540 - DNA, 973 bp, Homo sapiens
  misc_feature: GYAE6OF02I9WMG.8.73.G07.1.454.CMB.1.raw
  modified_base (132)..(132): a, c, t, g, unknown or other
  misc_feature (132)..(132): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggancagaaccagcagtcggggcaggttatgattgttctagttcggtaccgccaggttccaggcacacgcccccagacctcctcattaatgaataaacaactaatccggtccctcgtacggggtctctcgaccgtattctcctcgtccctacgaacgtctcggacctaccttcgtcgtccccttccgtggtcctattacgttcgttcggtcccgtccggaggggtacgaggtaggttacggacggtaccttaggtaacttttagttcccgttacgcccgtaaccctttccgtaaagtaccgtaaaccctaaacgtacccggtaccgtttaaggggttaaacttttaaccgggtttccgggggttacgtttccggggggtttacccggggtacccgggggtaccccgggggttaaacccgggttaaaccggggttttacccgggttaacccccggttttaccccgggttaacccgggtttacccggtaacccgggtaaacccccccgggttaaacgggttccccccgttaccccccgggtttacccccccggttacccgggtttacccgttaaccccggttttccccgggtttaccccccgggtttccccccggtttaccccccgttacccccgggttaccccggtaacccggttaccccgggaccggtaacccgggttaaccccgggttagggttaacccggggggtacccgggggtacccgtttaaccgggggggaacccccggttaacccgggggttccggtaaaccccgggtttacgggtaacccgtacgggggtacccttaggacccttagtacgggtccgtacgtcggacccttaggtcg

SEQ ID NO: 149541 - DNA, 670 bp, Homo sapiens
  misc_feature: GYAE6OF02JODZJ.8.73.G07.1.454.CMB.1.raw
  modified_base (225)..(225): a, c, t, g, unknown or other
  misc_feature (225)..(225): n is a, c, g, or t
  modified_base (640)..(640): a, c, t, g, unknown or other
  misc_feature (640)..(640): n is a, c, g, or t
  modified_base (662)..(662): a, c, t, g, unknown or other
  misc_feature (662)..(662): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
tcagctcgcgtgtccacgaccggtgctcgatttagctctacgctcagggtcctgggcccagtctgtactgacgcagccgccctcacgtatcctggggcccccagggccgacgaggggtctcccagtctcctgcactgggagcagaaccagcagtcggggcaggttatgattgttcatttcggtaccgtcctaggttccaggcacacgccccagactccgcattangataacaacaagtcgcctacgagggtcctcgtacgaccgtattactctgtccctccaagtcgtagctaccgttctcgtacccttcccgtggtcctattagtccttcggtacctccgtagggtcgtaggtcgtacggtaggtccgttaggttacgtttaaactttccggtagtacgtacggtccttaacgtagttactttaccggacggtactacgtaaccgtaaacgtggggtaacgttccggaagggtacggacgtagtacgtaccgtcgtacggtcacgtaccgaggtacccgccgtccccgtcgtcctaccgtaccgtcccttacccgtacccttacccgccgtacaccggtccgacgtccgtcggacgtccgggtctccgggtaacgacgggccgtacgtacgacggtacncgtacgtcagacgtcgatacgntaccncgn

SEQ ID NO: 149542 - DNA, 760 bp, Homo sapiens
  misc_feature: GYAE6OF02I8IJ1.8.73.G07.1.454.CMB.1.raw
  modified_base (307)..(307): a, c, t, g, unknown or other
  misc_feature (307)..(307): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacacgcccccagacctcctcactttaagtcgaactaaacaacaactccgggccccttacggacggggttcctcgtacgaccgtatttctcctcggtcctccaagttcctggcctactttcncgtaccccttccgtaggtcctagttacttccgttcgggttcctacccgtaggttcgggtaggaacgggtacgtgggtaacggtccttaaggttatttacgttaccgtcgaccccgttacttacctaagtcgaacctaacgtacgtcttagggttaagttacgttttacggtccgtttaccgggttcggggaccggggtacccggtaaccggtagtttaccggaccccgtttaccgtacggtaccgaccggtacccgtaacgggtcccttacccggcccccgtttcggtaccctaccgtttcccgttaccgtttcccccctacccgttacccgtaccggtcccgtaaccgcggtaccgtacgggtcgaccggggtccggtaccgtacgggaccggtaaccgggtccgtacacgggttaacgcgtacgccgttacgcgtacggatcgacctgaac

SEQ ID NO: 149543 - DNA, 704 bp, Homo sapiens
  misc_feature: GYAE6OF02I46FS.8.73.G07.1.454.CMB.1.raw
  modified_base (691)..(691): a, c, t, g, unknown or other
  misc_feature (691)..(691): n is a, c, g, or t
  modified_base (698)..(699): a, c, t, g, unknown or other
  misc_feature (698)..(699): n is a, c, g, or t
  modified_base (701)..(704): a, c, t, g, unknown or other
  misc_feature (701)..(704): n is a, c, g, or t
tcagctcgcgtgtccacgaccggtgctcgatttagctctacgctcagggtcctgggcccagtctgtactgacgcagccgccctcagtatctggggccccagggcagagggtctccatctcctgcactggggagcagaaccagcagtcgggggcaggttatgatgttcatttcggtaccgccgaggttccaggcacacgcccccagacctcctacaatttaatgaactaaacaaactaacgtccggccctcggacggggtcctctcgaccgtattctctgtccctaccgaagtcgtcggctacttcgtcgcccttccgtggtctatactcgtcggtcctccggtagggtggaaggagtggaggtcttagttaactttacgttcctcggtaccctaccgttaccctaatacgaaccaaacgtccgtaccgttaggtaacgtttgtttacgggtcgtttcgggttccgggcggggaccgggtaaccgtaacgggtttaccgacccggtttacccgtacgtaccgaccggtacccgtaacggcccgttcccggtaccccgttacggtacccttacccgttcccgttacccgtccccctacccgttcccgtaccggtacccgaccggtaccggtacgtcggtacgggacggtccggggaccgtcgggaaccgtacgggcgacggtaactaggcagncgatcgnngnnnn

SEQ ID NO: 149544 - DNA, 498 bp, Homo sapiens
  misc_feature: GYAE6OF01CO8BV.24.81.H04.1.454.CMB.1.raw
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (492)..(492): a, c, t, g, unknown or other
  misc_feature (492)..(492): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaatcatgatttatgatgtcagtaatcggcctcgagggcttctgatcgcttctctggctccaggtctggcaacacggcctccctgaccatctcgtgggcctcgaggctgagacgagctgactattattgcagttcagtgacagcagcagcttccgntcgtcggagtggaccaggtcaccgtcncgtcacgcccaacggcccaacccntgtacc

SEQ ID NO: 149545 - DNA, 497 bp, Homo sapiens
  misc_feature: GYAE6OF01D27I7.24.81.H04.1.454.CMB.1.raw
  modified_base (318)..(318): a, c, t, g, unknown or other
  misc_feature (318)..(318): n is a, c, g, or t
  modified_base (467)..(467): a, c, t, g, unknown or other
  misc_feature (467)..(467): n is a, c, g, or t
  modified_base (490)..(490): a, c, t, g, unknown or other
  misc_feature (490)..(490): n is a, c, g, or t
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaatcatgatttatgatgtcagtaatcggccctnaggggcttctgatcgcttctctggctccaggtctggcaacacggcctccctgaccatctctgggctccaggctgaggacgaggctgactattattgcagttcatggacagcagcagcttccggctctcggagtggaccaggtcacgtcncgtcacgcccaaggccaaccccntcgtacc

SEQ ID NO: 149546 - DNA, 378 bp, Homo sapiens
  misc_feature: GYAE6OF01ASD7I.24.81.H04.1.454.CMB.1.raw
  modified_base (374)..(378): a, c, t, g, unknown or other
  misc_feature (374)..(378): n is a, c, g, or t
tcagactactatgtcacgaccggtgctcgatttagtagtgtagattcgcgggcgcaccaagtacaacccctccctcgagagtcgagccagtatatcacctgacacctccatcaaccagttctccctgaaggtgacctctgtgaccgctgcggacacggccatgtattactgtgcgtgccaccgggcggggagttcgtttgactcctggggccagggaaccctggccaccgtctcctcagcctccaccaagggcccatcggtcttccccctggcgccctgctccaggagcacctccgagagcacagcggccctggggctgcctggtcaaggactacttccacatagtagtctgagcggctggcaaggcgcatagnnnnn

SEQ ID NO: 149547 - DNA, 503 bp, Homo sapiens
  misc_feature: GYAE6OF01DDWA6.24.81.H04.1.454.CMB.1.raw
  modified_base (397)..(397): a, c, t, g, unknown or other
  misc_feature (397)..(397): n is a, c, g, or t
  modified_base (496)..(496): a, c, t, g, unknown or other
  misc_feature (496)..(496): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgacctttgatgtttataagtttgtctcctggtatcaacaacacccaggcaaagccccaaatcatgatttatgatgtcagtaatcggccctcagggcttctgatcgcttctctggctcaggtctggcacacggcctccctgaccatctctgggctccaggctgaggacgnggctgactattattgcagttcagtgacaagcagcagcttccggctctcggaagtgggaccaggtcaccgtcctcggtcacgcccaacggcccaaccccntcgtacc

SEQ ID NO: 149548 - DNA, 499 bp, Homo sapiens
  misc_feature: GYAE6OF01ERUYM.24.81.H04.1.454.CMB.1.raw
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
  modified_base (471)..(471): a, c, t, g, unknown or other
  misc_feature (471)..(471): n is a, c, g, or t
  modified_base (493)..(493): a, c, t, g, unknown or other
  misc_feature (493)..(493): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaatcatgatttatgatgtcagtaatcggccctnagggcttctgatcgcttctctggctccaggtctggcaacncggcctccctgaccatctctgggctccaggctgaggacgaggctgactattattgctagttcatggacaagcagcagcttcggctcgtcggagtcggaccaggtcaccgtcncgtcacgcccaagcccaacccntgtacc

SEQ ID NO: 149549 - DNA, 501 bp, Homo sapiens
  misc_feature: GYAE6OF01BQM3B.24.81.H04.1.454.CMB.1.raw
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (496)..(496): a, c, t, g, unknown or other
  misc_feature (496)..(496): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaaccatcagtgaccttgatgtttataagtttgtctcctggtatcaaacaacacccaggcaaaagccccaaatcatgatttangatgtcagtaatcggccctgaggggtcttctgatcgcttctctggctcaggtctggcaacncggcctccctgaccatctctgggctccgaggctggaggacgaggctgactattattgctagttcatggaacaagcagcagcttcgctcgtcggagtgggacaggtcacggtctcgtcagcccacggccaacccngtgtc

SEQ ID NO: 149550 - DNA, 497 bp, Homo sapiens
  misc_feature: GYAE6OF01B39U9.24.81.H04.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagactactatgtcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttangatgtcagtaatcggccctnagggcttctgatcgcttctctggctcaggtctggcaacncggcctccctgaccatctctgggctccgaggctgaggacgaggctgactattattgcagttcatggacaagcagcagcttccggctctcggagtgggaccaggtcaccgtcncgtcacgcccaaggcccaacccntcgtc

SEQ ID NO: 149551 - DNA, 523 bp, Homo sapiens
  misc_feature: GYAE6OF01BJZTF.24.81.H04.1.454.CMB.1.raw
  modified_base (516)..(516): a, c, t, g, unknown or other
  misc_feature (516)..(516): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggcaaagcccccaaactcatgatttatgatgtcagtaatcggccctcaggggcttctgatcgcttctctggctccaggtctggcaacgacggcctccctgaccatcctctcgggctccgaggctgaggacgaggctagtacttattattgctagttcagtggacaagcagcacgcttccggctcgttacggaagtcgggaccaaggtccaccgtccgcggtcacgcccaaggcccaaccccntgtaccc

SEQ ID NO: 149552 - DNA, 503 bp, Homo sapiens
  misc_feature: GYAE6OF01CT94P.24.81.H04.1.454.CMB.1.raw
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaatcatgatttatgatgtcagtaatcggccctcagggcttctgatcgcttctctggctcaggtctgcacacgcctccctgaccatctctggctccaggctgaggatggagggtgattacgtactgcagtcgtcgaagatgttcggnggaggactaagctgaccgtctaggtcaggcccaggctcgccccctggtcactctnttccccncctcctacc

SEQ ID NO: 149553 - DNA, 529 bp, Homo sapiens
  misc_feature: GYAE6OF01DZPEH.24.81.H04.1.454.CMB.1.raw
  modified_base (519)..(519): a, c, t, g, unknown or other
  misc_feature (519)..(519): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgccccaaactcatgatttatgatgtcagtaatcggccctcaggggcttctgatcgcttctctggctccagtctggcacacggcctcctgaccatctctgggcctccgaggctgaggacgaggctgactattattgcagttcatggacaagcagcagtccttccggcttcgttacgggaagtcgggaaccgtaacggtccacccggttcctacggtcacgcccgaacggccccaaaccccncgtcgtaccc

SEQ ID NO: 149554 - DNA, 762 bp, Homo sapiens
  misc_feature: GYAE6OF01DUSBQ.24.81.H04.1.454.CMB.1.raw
tcagactactatgtcacgaccggtgctcgatttagtagtgtagattcgcgggggggtctcaggaggcagcgctctcgggacgtctccaccatggtcctgggctctgctattcctcaccctcctcactcaggcaccagggtcctgggtcccagtctgccctgtactcaacctgccttccgtgtctgggtctcctggacagtccgatcaccgatctcctggcactgccaaccatcgagtcgaccttgatgtttataagttgtcttcctggtatcaactaactacccaggcaaacgccccaaactcatgactttactgatgtcagtaatcggcctcgaggggcttctgactccgtcttttctaggtctccgtaggtctacgggtacctaacgaccggtcccgtcccctacggtaaccctaacgttccgttaccgttcggggacccttacccgtacgggtcccttagggaacgggaaccggtaacgggtacccttacgggtaaacccttaacgtttaacgtttacggtaccttacggttttaccaaggttacgggtaaacctaacgaccgtaacgtccgtaacggtcccgtttacccgggccgtttaccggttaaccgggtaaacggttcgggggtaacccctaaacgggggttacccgttaacccgggttccccggttccggggtaccctaacggggaaccccccgtaaacggggtacccccctaaaccccccggtaccgttaccggttcccgttaaaaccccgg

SEQ ID NO: 149555 - DNA, 514 bp, Homo sapiens
  misc_feature: GYAE6OF01AYUOE.24.81.H04.1.454.CMB.1.raw
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (508)..(508): a, c, t, g, unknown or other
  misc_feature (508)..(508): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaatcatgatttangatgtcagtaatcggccctcaggggcttctgatcgcttctctggctccaggtctggcaacncggcctccctgaccatctcgtgggctccgaggctggaggacgaggctgactattatgctagttcagtggacagcagcagcttccgcttcgtcggagtgggaccaaggtccaccggttcctcggtccacggcccaaggcccaaccccgntcgtcc

SEQ ID NO: 149556 - DNA, 524 bp, Homo sapiens
  misc_feature: GYAE6OF01AQ51I.24.81.H04.1.454.CMB.1.raw
  modified_base (365)..(365): a, c, t, g, unknown or other
  misc_feature (365)..(365): n is a, c, g, or t
  modified_base (516)..(516): a, c, t, g, unknown or other
  misc_feature (516)..(516): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggcaaagcccccaaatcatgatttatgatgtcagtaatcggccctcgaggggcttctgactcgcttctctggctccgaggtctggcaacncggcctccctgaccatctctgggctccgaggctggacggacgaggctaggacttattattgctagttcagtgaacagcagcagtccgtccgctcgttcggagtgggacctaggtccacgtccgtcggcacggtcccacggacccaaccccngtcgtacc

SEQ ID NO: 149557 - DNA, 618 bp, Homo sapiens
  misc_feature: GYAE6OF01BJVS1.24.81.H04.1.454.CMB.1.raw
  modified_base (224)..(224): a, c, t, g, unknown or other
  misc_feature (224)..(224): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccntcagtgaccttgattgtttataagtttgtctctgtatcaacaacaccaggcaaacgccccaaactcatgtatttatgatgtacagtaactccggccctcgaggggtcttctgtatcgtcttctcgtgctcaggtctggcacgaccgcctcctcgacctactcgtcgtcgggcctaccgaggtcgtggacgggacgacggtcgtacggtacttagttagttcgacgtagtttacagttacggaacgaacgcgacgtacacggtccttaccgggcttacggttacgggtaacggtacgggaacccgtaacggttccgtaaccccggttccgttaccgggtaccgaacccggtaccccgaaccggaaccccgtaacccccgtacgttccggtacccc

SEQ ID NO: 149558 - DNA, 575 bp, Homo sapiens
  misc_feature: GYAE6OF01BGPPP.24.81.H04.1.454.CMB.1.raw
  modified_base (301)..(301): a, c, t, g, unknown or other
  misc_feature (301)..(301): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaacgccccaaactcatgatttangatgtcagtaatcggcctcgagggtcttctgatcgcttctcgtcggctccgaggtctggacaacgaccggtcctcccgtgaccattccgtcgtcgggctccgagggctaggacgggacgaggtctacggtactagttacttgctagttcagtggaactaagcagctacgtcgttccggcttacggtacggaagtaccgggtaaccacgggttccaaccggtccgtaccggtaccgaacgtccccgaaacgtaccccaacccctgtcgtaacccg

SEQ ID NO: 149559 - DNA, 549 bp, Homo sapiens
  misc_feature: GYAE6OF01CXV0C.24.81.H04.1.454.CMB.1.raw
  modified_base (223)..(223): a, c, t, g, unknown or other
  misc_feature (223)..(223): n is a, c, g, or t
  modified_base (405)..(405): a, c, t, g, unknown or other
  misc_feature (405)..(405): n is a, c, g, or t
  modified_base (539)..(539): a, c, t, g, unknown or other
  misc_feature (539)..(539): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccntcagtgaccttgattgtttataagtttgtctcctggtatcaacaacacccaggcaaacgcccccaaactcatgtatttatgatgtcagtaatcggccctcgaggggcttctgatcgcttctctggctccaggtctggcacacggcctccctgaccatctcgtcggctccaggctgaggacgnggctgactattattgactagttcagtggaacaagtcagcacgtccgttccggtctcgttacgggaacgttcgggaacccgtaagggtcccaaccggttccctcgggtccacgcccgaacggaccccaaccccgngtcgtacccg

SEQ ID NO: 149560 - DNA, 523 bp, Homo sapiens
  misc_feature: GYAE6OF01BT0JF.24.81.H04.1.454.CMB.1.raw
  modified_base (367)..(367): a, c, t, g, unknown or other
  misc_feature (367)..(367): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcagggcttctgatcgcttctctggctcaggtctggcacacgcctcccngaccatctctcgggctccgaggctagaggacgaggctagacttattattgctagttcatggacaagcagcacgcgttccggctcgttcggagtcgggaccaagggtccaccggtccgtacggtcacggccccaaggccccaacccgcgtgtacccg

SEQ ID NO: 149561 - DNA, 507 bp, Homo sapiens
  misc_feature: GYAE6OF01ARNCN.24.81.H04.1.454.CMB.1.raw
  modified_base (354)..(354): a, c, t, g, unknown or other
  misc_feature (354)..(354): n is a, c, g, or t
  modified_base (500)..(500): a, c, t, g, unknown or other
  misc_feature (500)..(500): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctggtatcaacaacacccagcaaagcccccaaatcatgatttatgatgtcagtaatcggccctcgagggcttctgatcgcttctctgctcagtctgcaacncggcctcctgaccatctcgtgggctccgaggctgaggacgaggctgtactattatgcagttcagtgaacagctagcacgtcttccggcttcgtggacgtcgggaccacggtcaccggtcctcggtcacgcccaacgacccaacccntcgtacc

SEQ ID NO: 149562 - DNA, 564 bp, Homo sapiens
  misc_feature: GYAE6OF01DY5VH.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgcccccaaactcatgattttatgatgtcagtaatcggccctcgaggggtcttctgatcgctttctcgtggctccaggtctggacaacaccggcctccctgaccatctcgtgggcctccgaggctaggaggacgaggctgacttatttattgctagttcagtggaacaagcgagcacgtcttccggcttcgttacgggaaggttcgggaacctaacgggtccacccggttccgtacgggtaccgacgtaccccgaacggaccccaaacccccgtgtcgtacccg

SEQ ID NO: 149563 - DNA, 520 bp, Homo sapiens
  misc_feature: GYAE6OF01DGGMR.24.81.H04.1.454.CMB.1.raw
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
  modified_base (512)..(512): a, c, t, g, unknown or other
  misc_feature (512)..(512): n is a, c, g, or t
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagccccaaatcatgatttangatgtcagtaatcggccctcgagggcttctgatcgcttctctggctccaggtctggcacacggcctccctgaccatctcngggctcaggctgagacgagctgactatatgcagttcatgacaagcagcagcgttccggctcttacgggaaagttcgggaacctaaagggtccaaccggttcctcgggtcacggcccctaaaggccccaaaccccntggtaccc

SEQ ID NO: 149564 - DNA, 502 bp, Homo sapiens
  misc_feature: GYAE6OF01AB183.24.81.H04.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
  modified_base (495)..(495): a, c, t, g, unknown or other
  misc_feature (495)..(495): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattggtttataagtttgtctcctggtatcaacaacacccaggcaaagcccccaaatcatgatttangatgtcagtaatcggaccctcaggggcttgtgatcgcttctctggctcaggtctggcaacncggcctcctgaccatctctgggctccgaggctaggaggacgagctgactattatgactgtcagtgacagcagcagtcttcgnttcgtcggagtcggacaggtcaccgtcncggtcacgcccaacgccacccntcgtacc

SEQ ID NO: 149565 - DNA, 506 bp, Homo sapiens
  misc_feature: GYAE6OF01BLQ8Y.24.81.H04.1.454.CMB.1.raw
  modified_base (501)..(501): a, c, t, g, unknown or other
  misc_feature (501)..(501): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcaggggcttctgatcgcttctctggctccaggtctggcaacacggcctccctgaccatctctcgggctccgaggctgaggacgaggctgactattattgctagttcagtggaacagcagcagcttccggctcgtcggagtggacaggtcaccggtctcggcacgcccaacggcccaacccntgtcc

SEQ ID NO: 149566 - DNA, 527 bp, Homo sapiens
  misc_feature: GYAE6OF01E0J1F.24.81.H04.1.454.CMB.1.raw
  modified_base (520)..(520): a, c, t, g, unknown or other
  misc_feature (520)..(520): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctgtatcaacaacaccagcaaacgcccccaaatcatgatttatgatgtcagtaatccggcctcgagggtcttctgatcgcttctcgtggctccaggtctggacaaccgacggccctcccgtcgacctactcctcgtcgggcctccgaggctggaggtacgaggctagtactattagtgctagttcagtggacagcagcagtctcgctgtacggagtcggactaggtccacgtcctcggaccacgacccgaacggcccaacccgntcgtacc

SEQ ID NO: 149567 - DNA, 521 bp, Homo sapiens
  misc_feature: GYAE6OF01B3SX3.24.81.H04.1.454.CMB.1.raw
  modified_base (364)..(364): a, c, t, g, unknown or other
  misc_feature (364)..(364): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (514)..(514): a, c, t, g, unknown or other
  misc_feature (514)..(514): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctggtatcaacaacaccagcaaacgccccaaactcatgatttatgatgtcagtaatccggccctcgaggggtcttcgtgatcgtcttctctggctccaggtctggcaacncggcctccctgaccatctcgtgggcctccgaggctgacggacgaggctagacttattatgctagttcagtcggacaagcagcagtcctccgctcgtggagtgggacctaggtccncgtccncggtacacgacccaacggacccaacccgntcgtacc

SEQ ID NO: 149568 - DNA, 794 bp, Homo sapiens
  misc_feature: GYAE6OF01C22JY.24.81.H04.1.454.CMB.1.raw
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (319)..(319): a, c, t, g, unknown or other
  misc_feature (319)..(319): n is a, c, g, or t
tcagactactatgtcacgaccggtgctcgatttagtagtgtagattcgcggggggggtctcgaggacggcagcgctctcgggacgtctccactagtggcctgggctctgctaattcctcaccctcctcacctnagggctacgagggtcctgggccctagtctgccctgtaactcaacctgcctccgtgtctgggtctacctgggacagtcgagtcaccatcnctgcgatgacaacatcagtgacttgatgtttacaagtttgtctaccttggtatcaacaacacccaggcaaaacgccccaaacgtcaatacgattagngaagtgtcaagtaatccggcctcgtagggtcttcgtgacgtcggtcttacgtcgttacggactccgtaacggttctagggacccaaaaacggtccccgggtaccgtacccccgtacgtaacccttaacgttaccgttccggttccggggaccttacccggaaacgggtacccggttaacggaacggggaaaccgggtaaacgggtaccgttaagggttaaccctttaaagttttaacgtttaaccgggtaacgttaacggtttacccgtaacgggtttaacgggaaaccaaacgggtaccgaacgggtaaccgaacgttaccgttacccggtaccttacgggttaaccggggaaaagggttacggggaaacccgtaaacgggtacccgtaacccggttccccggttaccggtacccgttaaccggaccccgaaaccggtaacccgtaaaccccccggtacgtccggttaaccccg

SEQ ID NO: 149569 - DNA, 547 bp, Homo sapiens
  misc_feature: GYAE6OF01DETIN.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgccccaaactcatgatttatgatgtacagtaatcggccctcgagggtcttcgtgatcgtcttctctggctccgaggtctggcaacgacggcctccctgaccatctctcggctccgaggctgacggacgaggctgtactattatgctagttcagttgacaaggcagcagtcgttccggtcttcgttacggagttcgggaaccctaagggtccacccggttcctcgggtccaacggtccccaaacggcccaaaccccgtgtcggtaccc

SEQ ID NO: 149570 - DNA, 571 bp, Homo sapiens
  misc_feature: GYAE6OF01C3NNJ.24.81.H04.1.454.CMB.1.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcaatcagggcacagggtcctgggcccagtctgccctgactcaacctgcctccgtgtctgggtctcctggacagtcgatcaccatctcctgcactgcaaccatcagtgaccttgatgtttatagtttgtctctgtancaacaacaccaggcaaacgccccaancatgtatttangatgcagtaatcggccctgagggtcttcgtgactcgtcttctctcggtctccgtaggtctggccaacncggccctccctgaccatctcgtcgggcctcgaggctacggaggacgnggctagtaacttagttagttcgacgtagttcagtaggaacaacgcaacgcacggtccgttccggcttacgtacggggaaagttcggggaaccctaagggtcccacccggtccgtccgggtacaccgtcccgaaacggccccaaacccgtcgtcgtacccg

SEQ ID NO: 149571 - DNA, 675 bp, Homo sapiens
  misc_feature: GYAE6OF01BSJXN.24.81.H04.1.454.CMB.1.raw
  modified_base (382)..(382): a, c, t, g, unknown or other
  misc_feature (382)..(382): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggcaaacgcccccaaactcactgatttatgatgtacagtaatccggtccctcgaggggtcttcgtgtatcgctttctctggctccaggtctggctaacacggcctccngaccatctcgtcgggctccgaggtctggaggacgaggctgtaacttatttagttgactaggtttacacgtttaggaactaacggacgtacgaccgtaacggtcccgtttaccgggtcctttaccggttaaccggggtaaacggttacccgggggtaaccccgtaaaaccgggggtttccccgtaaacccccgggtttccccggttacccgggttacccgaaacccgggtacccccggtaaacccgggtaacccccctaaaacccccccgtacggtttacccgttaacccccgg

SEQ ID NO: 149572 - DNA, 664 bp, Homo sapiens
  misc_feature: GYAE6OF01C81K0.24.81.H04.1.454.CMB.1.raw
  modified_base (472)..(472): a, c, t, g, unknown or other
  misc_feature (472)..(472): n is a, c, g, or t
  modified_base (540)..(540): a, c, t, g, unknown or other
  misc_feature (540)..(540): n is a, c, g, or t
  modified_base (610)..(610): a, c, t, g, unknown or other
  misc_feature (610)..(610): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacgagggtcctgggcccagtctgccctgacctcaacctgcctccgtgtctgggtctccgtggacagtcgatcaccatctcctgcactgaccaaccatcaagtgaccttgattgtttaataagttttcgtctccgtggtatacaaacaaccaccgacggacaaaccgacccccaaactcaatgtatttatgtatgtacagttaacgtccggcccttacggacgggtcttcgtacgtactccggtcttcgtcgttcggtccttaccgtacggtccgttaggaccctaaaccgcccggtcccctaccccgtacgaccctagtccgttcgtcggccgtaccgngggtctaggaagggaccgaggtctacgtaagtttaacttagttcgacgttagtttagagtacgggaanaacggctacgacgttacgtcccgttcgtaccgttcgtaacgggaggtaccgggaaaccgtcgggtacccnccggtcccgttacggaccgtacgacccgaacgaccccaaccctcgtcggtaccc

SEQ ID NO: 149573 - DNA, 531 bp, Homo sapiens
  misc_feature: GYAE6OF01CFOIF.24.81.H04.1.454.CMB.1.raw
  modified_base (522)..(522): a, c, t, g, unknown or other
  misc_feature (522)..(522): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgcccccaaactcatgatttatgatgtcagtaatcggccctcgaggggcttctgatcgcttctctggctccaggtctggcaacgaccggcctccctgaccatcctcgtgggcctccgaggctgaggacgaggctgacttattattgcagttcatggacaagcagcagtcttccgcttcgttcggaagtgggacctaggtccacccggttcctcgggtcacggccccaacggaccccaaccccngtcgtaccc

SEQ ID NO: 149574 - DNA, 539 bp, Homo sapiens
  misc_feature: GYAE6OF01BSEX3.24.81.H04.1.454.CMB.1.raw
  modified_base (502)..(502): a, c, t, g, unknown or other
  misc_feature (502)..(502): n is a, c, g, or t
  modified_base (533)..(533): a, c, t, g, unknown or other
  misc_feature (533)..(533): n is a, c, g, or t
tcagactactatgtcacgaccggtgctcgatttagtagtgtagattcgcgggggggtctcaggaggcagcgctctcgggaagtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggacaaacgcccccaaactcatgatttatgatgtacagtaatccggccctcgagggtcttctgatcgcttctctggctcgaggtctggacaacgcgcctcctgacctatctcgtcggcctccgaggctgacggacgacggctagacttattagttgctagttcagtggaacaagcagcacgtccttccggcttcgtacggaggtcggacgtacggtccaccggttccncggtcacggacccaacggaccccaacccgtntcgtcc

SEQ ID NO: 149575 - DNA, 595 bp, Homo sapiens
  misc_feature: GYAE6OF01AVKKZ.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaacgccccaaactcatgtattatgatgtcagtaatccggcctcgaggggtcttctgactcgtcttcgtctggcctcaggtctcggcaaccgacgccctcccgtgacctacttctcgtggtcctcgacggtcgtaggaggacgaggctagtacttattagttcgactacgttcacgtggtaacagtacacgacacgtccgttccggcttacggttaccgggtaagtaccggggaaccgtaggttaccccgaccggttcccgttaccgggtacaacccggaccccgaaccggaccccaaaccccgtcgtccggtacccc

SEQ ID NO: 149576 - DNA, 631 bp, Homo sapiens
  misc_feature: GYAE6OF01BL522.24.81.H04.1.454.CMB.1.raw
  modified_base (296)..(296): a, c, t, g, unknown or other
  misc_feature (296)..(296): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactgcaaccatcagtgaccttgattgtttatagtttgtctcctggtatcaacaacacccaggacaaacgcccccaaatcatnatttatgatgtcagtaatccggccctcgaggggtcttcgtgtatccgtcttcgtctggctaccgaggtctcggaccaaccgaccggtcccttaccctggacctacgtcctcgtcgggcctccgagggtctaggacgggtacgacggtctggtaactagtttagtcgacttagttcgaagttggaacaacgtcgagtcctacggtccgttccggcgttacgtacgggtaacggtcgggaaccgtaacgggttcccgtacccggttccgtacccgggttaccgaacccgggtaccccgaaacccgggaccccaaaccccgtaccgttcggtaacccc

SEQ ID NO: 149577 - DNA, 671 bp, Homo sapiens
  misc_feature: GYAE6OF01BYCH2.24.81.H04.1.454.CMB.1.raw
  modified_base (223)..(223): a, c, t, g, unknown or other
  misc_feature (223)..(223): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccntcagtgaccttgattgtttataagtttgtctctggtatcaacaacaccaggacaaacgcccccaaactcatgtatttatgatgtcaagtaactccggcctcgaggggtcttcgtgatcgtctttctcgtggcctcgaggtctacggacaaccaccggccctcccgtacgaccacttccgtcgtcgggccttccgagggtcctagggacgggtaacggaggtccgtagtaacgttaactttagttacgacgttaggtttacctaaggttacggaacgaacgacgacggtaccaacggttcccgttccggtaccgtttaccggtaaccgggtacgggttaccgggaacccggtaaacgggttcccgacccgggttcccgttaccgggttacccgaaccggtaacccccggaaacgggaccccccaaaccccgttcgtccggttaaccccg

SEQ ID NO: 149578 - DNA, 571 bp, Homo sapiens
  misc_feature: GYAE6OF01AGQSA.24.81.H04.1.454.CMB.1.raw
  modified_base (230)..(230): a, c, t, g, unknown or other
  misc_feature (230)..(230): n is a, c, g, or t
  modified_base (372)..(372): a, c, t, g, unknown or other
  misc_feature (372)..(372): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtnaccttgattgtttataagtttgtctcctggtatcaacaacaccaggcaaagcccccaaactcatgatttatgatgtcagtaatcggccctcgacggggtcttcgtgactcgctttctcgtggcctccgaggtctggccaacnccggtccctcccgtcgaccacttcctcgtcgggccttccgaggcctaggaggacgaggctgaccttatttatgtactagttccagtaggacaagcagcacgtccttccggctcgttacggaacgtacgggaaccgtagggtaccctaccggttcctcgggtccacggtacccaacggaccccaacccgcgtcgtacccg

SEQ ID NO: 149579 - DNA, 680 bp, Homo sapiens
  misc_feature: GYAE6OF01CA1KX.24.81.H04.1.454.CMB.1.raw
  modified_base (668)..(668): a, c, t, g, unknown or other
  misc_feature (668)..(668): n is a, c, g, or t
tcagactactatgtcacgaccggtgctcgatttagtagtgtagattcgcggggggggtctcaggaggcagcgtctcgtcgggacggtctccaccatggcctgggctctgctaattcctcaccctcctcactcagggcacagggtcctgggcccagtctgccctgactcaacctgcctccgtgtctgggtctcctggacaggtcgatcaccgagtcctaccgtgccgtactcgccaaccatcacgtcgaccttggacttgtttactaacgtttcgtctccgtggtactaccaacaaccgaccacggaccaaaccgaccccaaatccatacgtactttacgtgacttgtctaaggtaacgtccggtccctacgtacggggtccttcgtcgtactcgtcttcgtcgtcggtctcgacggtctgacacgccggtcctcctcgactactcgtcgtcgggcctacgacggtcgtacgggaacgggacggacggtcgtaaggtaaccttagtttacgttcgtacgttacggttaccaggttacggaacaacggaccgaggccgttaacggtccgttccggtcgttaccggttacgggaacggtacgggtaaccgtaacggtcccgtaccggttccgtaccggtccgaccgacccgaacggtaccccaaccccgtnttcccggtaccc

SEQ ID NO: 149580 - DNA, 548 bp, Homo sapiens
  misc_feature: GYAE6OF01D8XIU.24.81.H04.1.454.CMB.1.raw
  modified_base (356)..(356): a, c, t, g, unknown or other
  misc_feature (356)..(356): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaaccatcagtgaccttgattgttttataagtttgtctctggtatcaacaacaccaggacaaacgccccaaactcatgtatttatgatgtcagtaactcggccctcgaggggtcttctgatcgtcttctctggctcnggtctggacacgacgcctcctcgaccatctcgtcgggcctcgacgggtctggaacggacggacggtctagtacttattatgctagtcagtgactagcgagcacgtcgtccggcttcgttacgggaggtcgggaccgtaggtccaccggttccgtcggtcaccggcccaacggccccaacccgtgtcgtaccg

SEQ ID NO: 149581 - DNA, 528 bp, Homo sapiens
  misc_feature: GYAE6OF01ETDO4.24.81.H04.1.454.CMB.1.raw
  modified_base (520)..(520): a, c, t, g, unknown or other
  misc_feature (520)..(520): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagccccaaatcatgatttatgatgtcagtaatcggcctcgagggcttctgatcgcttctctcggctcaggtctggacaacgacggcctccctgaccctatctcgtcgggctccgaggctggacggacgaggctagtacttattattgctagttcagtggaacaagcagcagtccttccggctcgtcggaagtcgggaccgaggtccaccggtcctcggtcacgtcccgaaggccccaacccngtcgtacc

SEQ ID NO: 149582 - DNA, 696 bp, Homo sapiens
  misc_feature: GYAE6OF01EQHJU.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttaataagtttgtctcctggtatcaacaacaccaggacaaacgcccccaaatcatgtatttatgatgtcagtaatcgccctcgaggggtcttcgtgactcgtcctttctcgtcggcctaccgaggtctcggacctaaccgaccggtccctcccgtacgaccctacttccgtcgtcgggtcctccgtagggtcgtagggaacgggacggtaggtcctacgtaaccttaagtttacgttaggacgttacgtttaccgaagttacgggaacctaaggcccgaagtaccgtaacgtcccggtttacccggccgtttaccggttaccggggtaaagggttaccggggtaaccgtaaaccggggttccccgtacccggttaccccggttccgggtacccaaacccgggtacccccgaaacccgggtacccccaaaacccccgtcgttcccggtaacccccg

SEQ ID NO: 149583 - DNA, 560 bp, Homo sapiens
  misc_feature: GYAE6OF01EOCPD.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagttttgtctcctggtatcaacaacaccaggcaaacgcccccaaactcatgatttatgatgtcagtaatcggccctcgaggggcttctgatcgtcttctctggctcaggtctggcaacgacggcctccctcgaccacttctcgtcgggtcctccgaggctggacggacggaggctgacttattatgctagttcagtggacaagcagcgagtccgttccggcttcgttacggaggtcgggaacccgtacggtcccaccggttccgtccgggtacaccggtaccccgaacggaccccaaaccccctcgtccgtacc

SEQ ID NO: 149584 - DNA, 446 bp, Homo sapiens
  misc_feature: GYAE6OF01D5JNU.24.81.H04.1.454.CMB.1.raw
  modified_base (432)..(446): a, c, t, g, unknown or other
  misc_feature (432)..(446): n is a, c, g, or t
tcagactactatgtcacgaccggtgctcgatttagtagtgtagattcgcgggcgcaccaagtacaacccctccctcgagagtcgagccagtatatcacctgacacctccatcaaccagttctccctgaaggtgacctctgtgaccgctgcggacacggccatgtattactgtgcgtgccgaccggggcggggagttcgtttgactccgtggggccagggaaccctggccaccgtctcctcacgcctccaccgaacgggcccagtccggtccttcccccgtggccgcccctgcctccgagggacgcccacccgtccgagacgaccacgacggccggccccgtggggcctgcccgtagggtaccaaaggtaccttaaccttcccgaactaagtagtagtctggacggcgggctgggacaacggcgacaagtcgnnnnnnnnnnnnnnn

SEQ ID NO: 149585 - DNA, 595 bp, Homo sapiens
  misc_feature: GYAE6OF01C3A96.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgccccaaactccatgatttatgatgtacagtaatccggccctcgaggggcttctgatcgcttctcgtggctcgagtcgtcgacacgacgccctcctcgacctatccgtcgtcgggtcctaccgacggtctaggacggtaacgacggcgtaggtaacttagtttacttggtacgtacgtttccgagttacggaactaacggcgtaagcgtaacgtcccgttccggactttccggttacgggaaggtcgggaaccgtacgggtcctacccggtctaccggtacacggacccaacggacccaacccctcgtcgtaccc

SEQ ID NO: 149586 - DNA, 589 bp, Homo sapiens
  misc_feature: GYAE6OF01BNSYI.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgttataagtttgtctctgtatcaacaacaccaggacaaacgacccccaaatcatgatttatgatgtcagtaactcggtccctgaggggtcttcgtgatcgcttctacgtggcctccgtaggtctggtaccaacgaccggccctcccgtacgacctactccgtcgtcgggcctccgaggtctaggacggacgaggctagacttattagttgctagtcagttcggaacagacgagctagccttaccgacttcggttacggaacggtacgggaacccgtaaggtcccgaacccggttcccgtaccggttaccacggtaccccgaaccggaccccaaccccgtacgtcgtaccc

SEQ ID NO: 149587 - DNA, 538 bp, Homo sapiens
  misc_feature: GYAE6OF01AV7W0.24.81.H04.1.454.CMB.1.raw
  modified_base (467)..(467): a, c, t, g, unknown or other
  misc_feature (467)..(467): n is a, c, g, or t
  modified_base (525)..(525): a, c, t, g, unknown or other
  misc_feature (525)..(525): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgccccaaactcatgatttatgatgtcagtaatcggccctcgaggggtccttctgtatccgtctttctcgtcggctccagggttctcggacaaccgaccgggccctccccgtgaccctattcctccgtgggcctccgaggctaggacgggacgaggctggtacttagttactgctagttcagtcganagcagcagtctaccgctcgtcggagtcgggacaggtcaccggtctcgcacgccagccncgccccgtggtcc

SEQ ID NO: 149588 - DNA, 428 bp, Homo sapiens
  misc_feature: GYAE6OF01CJCYM.24.81.H04.1.454.CMB.1.raw
  modified_base (407)..(407): a, c, t, g, unknown or other
  misc_feature (407)..(407): n is a, c, g, or t
  modified_base (414)..(428): a, c, t, g, unknown or other
  misc_feature (414)..(428): n is a, c, g, or t
tcagactactatgtcacgaccggtgctcgatttagtagtgtagattcgcgggcgcaccaagtacaacccctccctcgagagtcgagccagtatatcacctgacacctccatcaaccagttctccctgaaggtgacctctgtgaccgctgggcggacacggccatgtattactgtgcgtgccgaccggggcggggagttcgtttgactcctggggccagggaccctggccaccgtctcctcacgcctccaccaacgggcccatcggtccttccccgtggccgccctgcctccgaggacgccacccgtccgagacgcacaggccggcccgtggggctcggccgtcggtaccaacggtaccttaccttccaactaagtagtagtcgtggacggcgggctgggcgaaggcncaatagnnnnnnnnnnnnnnn

SEQ ID NO: 149589 - DNA, 794 bp, Homo sapiens
  misc_feature: GYAE6OF01C7YO2.24.81.H04.1.454.CMB.1.raw
  modified_base (343)..(343): a, c, t, g, unknown or other
  misc_feature (343)..(343): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactgcaaccatcagtgacctttgattgttttataagtttgtcttcctggtatcaacaacacccaggacaaacgccccaaactcatgtatttatgatgtacagtaactccggtacctcggagggtcttntgactccgtctttctcgttcggccttccgtaggttcgtacggaccaacggtacccggtcccttcccgtacggacccttgtcccgttcggtacggggtccttacccggaggggtccgtacgggaacggggtaaccggtacgggtccgttaacgttaacctttaagttttacggtttaccgacggttaacgttttaccgaacggtttaacggggaaacccaaagggtaccgtaacgggtaccgtaacgggttccccggttttcccggggaacccgttttaccggggttttaaaccggggaaacggggtttaccgggggtaaaccccgttaaaccgggggttccccgtaaaccccgggtttccccggttacccgggggttaacccaacccggggtaacccccgaaacccggggaccccccctaaaccccccgttaggttcccgttaaacccccg

SEQ ID NO: 149590 - DNA, 575 bp, Homo sapiens
  misc_feature: GYAE6OF01BHNIR.24.81.H04.1.454.CMB.1.raw
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggacaaagcccccaaactcatgtatttatgactgtcagtaactcggccctcgaggggtcttctgatcggtcttctctgctcagtctggcaacncggcctcctgaccatctctgggctccaggcgtaggacggacgngcgtacgtacttattagttcgctacgttacagttcggaactaagcaagcacgtcgttccggactccggttcggaacgtacgggaaccgacggttaccaccggttccctaccgggtaccaccggtaccccggaacgaccccaaccccgtaccgttcgtaaccccg

SEQ ID NO: 149591 - DNA, 733 bp, Homo sapiens
  misc_feature: GYAE6OF01DY3QG.24.81.H04.1.454.CMB.1.raw
  modified_base (314)..(314): a, c, t, g, unknown or other
  misc_feature (314)..(314): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccatcagtcgaccttgattgtttaataagtttcgtctccgtggtactacaacaaccacccaggacaaacgcccccaaactcatagtatttangtatcgtcagtaactccggccctcggaggggtcttacgtgtactccgtctttcgtcgtacggtcctccgtaggtcttacgggacccaaaccgtacccgggtccccttacccctacggtaaccctacttcccgttacggtccggggtacctaccccggacgggtaccgttacgggaacgggtaaccggtacgggtcctacggttaactttaatttacgttggacgttagttaccaggttacggaactaaggtccgaagcctaggtcccgttccgggtccttaccgggttaaccgggaacgggttaaccggggtaacccgtaacgggtttaccccggcccggtttacccggttcccggtaaccgaaccggtaccccccggtaaacggaccccccctaaacccgtccgttccgttaaccccg

SEQ ID NO: 149592 - DNA, 533 bp, Homo sapiens
  misc_feature: GYAE6OF01CH7W1.24.81.H04.1.454.CMB.1.raw
  modified_base (525)..(525): a, c, t, g, unknown or other
  misc_feature (525)..(525): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgcccccaaatcatgatttatgatgtcagtaatccggccctcgaggggtcttctgatcgctttctctggctcaggtctcggacacacggcctcccgtgacctatctcgtgggcctcgaggctggacggacgaggctgacttattattgctagttcagtggaacagcagcagtcgttccgcttgttcggaacgtgggaccgtaaggtccaccggttccgtcggtcacgcccaacggcccaaccccntcgtaccc

SEQ ID NO: 149593 - DNA, 492 bp, Homo sapiens
  misc_feature: GYAE6OF01EKPUX.24.81.H04.1.454.CMB.1.raw
  modified_base (371)..(371): a, c, t, g, unknown or other
  misc_feature (371)..(371): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (487)..(487): a, c, t, g, unknown or other
  misc_feature (487)..(487): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaaagcccccaaaatcatgatttatgatgtcagtaatcggccctcaggggcttctgatcgcttctctggctccaggtctggcaacacggcctccngaccatctcgtggctccgagctagaggacgaggctgactattatgcagtcatggacaagcagcagcttcggctntcgaagtggaccagtcacgtcngtcagcccaaggcccaaccntgtac

SEQ ID NO: 149594 - DNA, 626 bp, Homo sapiens
  misc_feature: GYAE6OF01B7YE2.24.81.H04.1.454.CMB.1.raw
  modified_base (252)..(252): a, c, t, g, unknown or other
  misc_feature (252)..(252): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactgccaaccatcagtgaccttgatgtttataagttntctctgtatcaacaacaccagacaaacgcccccaaactcatagtactttatgatgtctaagtaatccggaccctcggacggggtcttcgtgtatcgtactttctcgtcggcctcgtaggttcctacggtaccgaaccgacccgggtcccttccccgtacgaaccctagttccctcgtccgggtctccgaagtcgtaggaggaccggaggcctgaacttattacgttagactagttacagttcggaacagacgacgactcgtaccgttccgcgttccgtacgggtaacggtacggaaccgtaggtacccgtacccggttccgtaccggtcaaccggtaccccgaaccggacccaaccccctacgtcgtaaccccg

SEQ ID NO: 149595 - DNA, 793 bp, Homo sapiens
  misc_feature: GYAE6OF01DD2V9.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtcgtgggtctcctggacagtcgatcaccatcctcctgcactgaccaaccatcagtcgtaccttgattgtttaattagtttcgtccttccgtaggttatacaaaccaaccacccgaggaccaaaccgaccccctaaaactcaatacgtaattttagtacgtatacgtactaagtaacgtccggtacccctacggacggggtccttcgtcgtaacttccgtcgtttcctcgtcggtcctccgtacggttccgtcggaaccaacccgtccgggtaccccttccccgtaacggaacccttacgtccgttaccggtcgggtaccctccgaacgggtccgtagggaccgggtaacgggacgggtaccttacggttaacctttaagtttacgttcggtacgtacgtttacgaaggttaacggaacgttaacggacgacggtaccgtaccgttccggttcccggtacgtttaccgggttacggggtaaacgggtaccgggaaaccccggttaaacgggttccccgtaaacccgggtttcccgttacccggggtacccgtaaccccggtaaccccgggtaaacccggacccccctaaaccccggtccgttacccggttaaccccg

SEQ ID NO: 149596 - DNA, 637 bp, Homo sapiens
  misc_feature: GYAE6OF01EMPAN.24.81.H04.1.454.CMB.1.raw
  modified_base (415)..(415): a, c, t, g, unknown or other
  misc_feature (415)..(415): n is a, c, g, or t
tcagactactatgtcacgaccggtgctcgatttagtagtgtagattcgcggggggggtctcaggaggcagcgctcgggtcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgaccaaccatcagtcgtaccttgatttgttttaataagtttcgtctcctggtatacaacaacacccagacaaacgacccccaaactcatgtatttatgtatgtcaagtacgtccggcctgacgggtcttctgactccgtcttctcgtggcctccgaggtcgtcggacaaccgccgtccctccgtacgacctcgtntccggtcggtcctcgaggtcgaggacggacgacgtcgtacgtaattagttacgtcgtacttagtcgacggtacggaacgacgacgtacgtacgacgttccgtaccgtcgttcgggtacggtacgggtaaccgtaaccggtaccggtacccgttacccggtccgtccggaaccgaaccccggtaccggaaccccgtaccccctaaccccgtgtccgtaccccg

SEQ ID NO: 149597 - DNA, 717 bp, Homo sapiens
  misc_feature: GYAE6OF01B0ZUL.24.81.H04.1.454.CMB.1.raw
tcagactactatgtcacgaccggtgctcgatttagtagtgtagattcgcggggggggtctcaaggaggcagcgctctcgggacgtctccaccatggcctgggctctgctattcctcacctcctcacttcagggcacagggtcctgggcccagtctcgccctgactcaacctgcctcgtgtctgggtctcctggacagtcgatcaccatctcctgcactgcaaccatcagtgaccttgattgtttatagttgtctctggtatcaacaacaccaggacaaagccccaaatcatgtatttatgaatgtacagtaactccggcctagaggggtccttacgtagtaactcgtctttacgtcgtggcctcgaaggtctaggaccaaccgtaccggtcccttacccgtacgaaccctagtacccgttcgtacgggtcctaccgtacggcgttaacggacgggaacgtacgggtcttacggtaacgttacgttttaacgttcgtaacgttacgtttaccaacggttacggtaacaaacggccgtaacggtaccgtacggttccggtttcccggaccgtttacgggttaccggggtaaacgttaccgggggaacccgtttaaggggtcccgttaaccccggttcccggtcggttaacccgtaacccggtaccccggtaaaacccgggaccccctaaacccccgttggttaccccggttaaaccccg

SEQ ID NO: 149598 - DNA, 598 bp, Homo sapiens
  misc_feature: GYAE6OF01AGXQU.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaaccatcagtgaccttgattgtttataagtttgtctcctgtatcaacacaccagcaacgccccaatcatgtatttatgatgtctagtaactccggccctcgacgggtcttcgtgatccgtcttctcgtcggcctccgtaggtccgtggaccaaccgtaccggtccctcccgtgaccctatccgtacgtcgggcctccgaggtcgtaggacggacgaggtctagtacttagttacgtgctagttcagttacggaactacgcgtagcacgtccgttccggtcgttccgtacgggacggtacgggaccgtacgggtccgtacccggtccgtccggtaccgaccggtaccccgaacggacccccaacccgtcgtcggtaccc

SEQ ID NO: 149599 - DNA, 775 bp, Homo sapiens
  misc_feature: GYAE6OF01EF9N8.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaaccatcagtcgtaccttgattgttttaataagtttgtctcctggtatcaacaacacccaggacaaacgcccccaaactcatagtatttatgtatgtactaagtaacgtccggtccctcggacggggtcttcgtgactcgtcttccgtcgttcggtcctccgtacggttcgtacggacctaaccggtacccggtccccttacccgtacgaaccctacgttccgtcggttacgggcctaccgacgggtcgtagggaacgggaacggacggtccttacgtaactttaagtttacgttcgtacgttaacgtttcgaaggttacggaacaacggacgtaacggtccgtaacgttcccggttacccgggtacccgtttaccgggtttaaccggggtaaacgggttacccgggggtaaacccggttaaccggggttacccccgtaaccccggggtttccccggttacccggggttacccgaacccccgggtaacccccggtaaaaccccgggtaaccccccctaaaacccccgttcccgttacccggttaaaccccccgg

SEQ ID NO: 149600 - DNA, 752 bp, Homo sapiens
  misc_feature: GYAE6OF01EK0GZ.24.81.H04.1.454.CMB.1.raw
  modified_base (222)..(222): a, c, t, g, unknown or other
  misc_feature (222)..(222): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcacatctcctgcactgcaaccntcagtcgaccttgattgtttaactaagtttcgtctcctggtatacaacaacacccaggacaaacgaccccaaactcatcgtatttatagatgtacaagttaacgtccggtcccgtacgacggggtctttcgtgtacgttcgtcttccgttcgtcggtccgttccgtagggttccgtacgggtacctaaacccggaacccgggtccccttccccgtacggaaccctacgttcccgttccggtccgggtcctacccgtacgggtcccgttacggggaacgggtaaccggacggtacgtttacggtaactttaacgttttagttacgtcgtttaacggttcctaacggttacgaaccggaacggacgtaacgtccgtacgttaccggtttccggtccgttacgggtttaaccgggaacgggtaccgggtaaccggtaacggtacccggtaaccccggtcccggtttcccgggtaccgtaacccggtacccgaaacccgggtaacccccaaccccggttcgtaccggttacccc

SEQ ID NO: 149601 - DNA, 743 bp, Homo sapiens
  misc_feature: GYAE6OF01ENNYJ.24.81.H04.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccacatctcctgcactgacaaccntcagtcgaccttgattgtttatagtttntctctgtatacaacacaccaggacaaacgcccccaaatcatgatttangtatgtacagtaacgtccgtccctgtacggggtcctttcngtactccgtcttcgtcgtcggtcctacgtacgggtctcggactaacccgaccggtcctcccgtcgtaacctacttacgtccgttcgggacctaccggtaggtaccgtcgggaacggtaccgggacggtaaccgttcggttaaaccgtttaagtttacgttacggtacgttaaccggtttcgtaaggttaccgggaaaccgttaaggacccgttaaacgggaccccgttaggtaaccccggtttcccgggtaacccgtttaccggtttaaacggggtaaccggggttaaccgggtaaaccccgtaaccgggttaccccgtacccggtttcccggtacccggtacccgacccggtaacccccggtaaccggaacccccgttaaaccccgtcgttgttaaccccgg

SEQ ID NO: 149602 - DNA, 678 bp, Homo sapiens
  misc_feature: GYAE6OF01DK1Y8.24.81.H04.1.454.CMB.1.raw
  modified_base (329)..(329): a, c, t, g, unknown or other
  misc_feature (329)..(329): n is a, c, g, or t
tcagactactatgtcacgaccggtgctcgatttagtagtgtagattcgcggggggggtctcaggaggcagcgctctcgggacgtctccaccatggcctgggctctgctattcctccaccctcctcactcagggcacagggtcctgggcccagtctgccctgactcaacctgcctccgtgtctgggtcctcgtggacagtcgatcaccatcctcctgcactcgaccaaaccattcaagtcgtaccttgatttgtttaattaagtttcgtcttccgtggtacaacaacaaaccaccgaaggaccaaacgaccccaaactcatagtacttancgtatgtacaagtactcggcctagagggtctcgtgtactcgtcttcgtcgtaggtcctacgtaggttactcggaacctaacgacccggtccttacccgtcgaacctatccgtcgtcgggtacctacggaggcttgggaacggagtcggtactgttaacgttattacgtgtatagtacgacgtaggactaaggcagaccgagtcccggttccggacttccggttaacgggaaacggttacgggaacgttaacccccccgggtagttaccccggttacccgacggttaacccgaaccggttaccccgaaaacggttaccccccgaaaccccttaaggtcccttaaccccgg

SEQ ID NO: 149603 - DNA, 380 bp, Homo sapiens
  misc_feature: GYAE6OF01A96F1.24.81.H04.1.454.CMB.1.raw
  modified_base (345)..(345): a, c, t, g, unknown or other
  misc_feature (345)..(345): n is a, c, g, or t
  modified_base (378)..(380): a, c, t, g, unknown or other
  misc_feature (378)..(380): n is a, c, g, or t
tcagactactatgtcacgaccggtgctcgatttagtagtgtagattcgcgggcgcaccaagtacaacccctccctcgagagtcgagccagtatatcacctgacacctccatcaaccagttctccctgaaggtgacctctgtgaccgctgcggacacggccatgtattactgtgcgtgccaccgggcggggagttcgtttgactcctggggccagggaaccctggccaccgtctcctcagcctccaccagggcccatccggtccttccccctggccgccctgcctccaggagcacctccgagagcacagccggccctgggctgcctggtcaaggactacgttccanatagtagtctgagcggctggcaaggcgcatagnnn

SEQ ID NO: 149604 - DNA, 685 bp, Homo sapiens
  misc_feature: GYAE6OF01CFCLL.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccatcagtcgaccttgattgtttataagtttgtctcgtgtactcaacacaccagacaaacgccccaactcatgtatttatgtatgtacgagtaacgtccggccctggacgggtcttctagactccgtctttcgtcgtcggcctcgtacggtcgtacgaccacgaccggtccctcccgtacgacctacgttccgtcggtacgggtcctaccggacggtcgtacgggagggtaccggaacggtctaggttaactttagtttacgttacgcgtagtttaccgaggttaccgaacgtaacgccgaggtaccgtacgttacccggttaccgtcgttaccgggtacgggtaaacgggtcggtaaacccgtaaacgggttcccctacccgggtttcccgaccgggttaaccgtaccccggaaccccggttaaaccggaccccccgaaccccttacgtcccggttaacccg

SEQ ID NO: 149605 - DNA, 672 bp, Homo sapiens
  misc_feature: GYAE6OF01D0JH4.24.81.H04.1.454.CMB.1.raw
  modified_base (227)..(227): a, c, t, g, unknown or other
  misc_feature (227)..(227): n is a, c, g, or t
tcagactactatgtcacgaccggtgctcgatttagtagtgtagattcgcggggggggtctcaggaggcagcgctcgtcgggacgtctccaccatcggcctgggctctgctattcctcaccctcctcactcagggcacgagggtcctgggcccagtctgccctgactcaacctgcctccgtgtctgggtctcctggacagtcgatcacatctcctgcactgacaaccntcagtcgacttgattgtttatagtttgtctcgtgtatacaacaacaccaggacaaacgaccccaaactcatacgtatttatgatgtactaggttaactcggtccctacggacgggtccttgtacgtattccgtctttcgtcgttcggcctcgtacggtcgtaccggacaaccggtaccggtcctcccgtacgaaccgtacttccgtcggtcggtccttcgacgggtctaggacggacgtggctacggtaacttagtttagtcgtacgtacttacgagtacggaaacgacgacgtaacgccgtacggtcccgtttcccggacgtttccgggttaacgggtacgggtaccggaaccggttccggtacccgttacccggttcgtacccgggtcccaacccgggtaacccgtaacccggaaccccaaaccccgttgtcccgttaacccg

SEQ ID NO: 149606 - DNA, 760 bp, Homo sapiens
  misc_feature: GYAE6OF01EGA2K.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttatagtttgtctctggtatcaacaacaccaggacaaacgcccccaaatcaatgatttatgatgtacagtaactcggccctgagggcttctgatcgtcttctcgtggtctccgacggttctcggaccaaccgtaccggtccccttacccgtacgtaacccctacgttcccgttccggttccggggtaccttaccccggtaacgggtccgttaacggggaaccggggtaaccgggtacgggtaccgttaacgggttaaacctttaaagttttacgttcggtacgtttaacggtttacgtaacgttacgggaaccaaacggtccaacggaccgttaaccggttcccggttacccggtccgtttaccggttaccgggggaaacggttaccgggggtaaaccccgttaaacggggttacccctaacccgggtttccccgttaccggggttacccgaaacccgggtacccccgtaaaaccggggaaccccccttaaacccccgtccggtttccgttaacccccg

SEQ ID NO: 149607 - DNA, 598 bp, Homo sapiens
  misc_feature: GYAE6OF01B0QVA.24.81.H04.1.454.CMB.1.raw
  modified_base (224)..(224): a, c, t, g, unknown or other
  misc_feature (224)..(224): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccntcagtcgaccttgattgtttactaagtttgtctcctggtatcaacaaccaccaggcaaacgcccccaaatcatgatttatgatgtcagtaacgtccggccctcgaggggtccttcgtgtactcgtcttctcgtcggccttcgacggtcgtggaccaacgccggtccctcccgtcgacctattccgtcgtcgggcctccgaggcctggacggtcgacggctagtaacttattactgactagttacagttcgaactaacgcgacgacgtacgtccgttccgcttccggtacggtaggtacgggaacgtacggtacctacccggttcgtccgtaccgaccggtacccgaacggaccccaacccgtcgtccggtaccc

SEQ ID NO: 149608 - DNA, 548 bp, Homo sapiens
  misc_feature: GYAE6OF01DN9YU.24.81.H04.1.454.CMB.1.raw
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcgaggcacagggtcctgggcccagtctgccctgactcaacctgcctccgtgtctgggtctcctggacagtcgatcaccatctcctgcactgcaaccatcagtgaccttgattgtttatagttgtctctggtatcaacaacaccagcaacgccccaaatcatgatttatgtatgtacagtaatccggccctcgagggtccttagtgatcgcttctctcgctcgagtctgacacgacgcctccngactatcgtacgngtctcgagntgaggacgagtctacgtacttattatgctagtcgagtcgaacagcagcgatccgtccgcttcggtacggaacggtcgggaaccgtaggtacctacccggtcgttacgtccgaaccgtccccgaaacggacccctaaaccccgacgtcgttaaccccg

SEQ ID NO: 149609 - DNA, 693 bp, Homo sapiens
  misc_feature: GYAE6OF01AKIFP.24.81.H04.1.454.CMB.1.raw
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatctcctgcactgcaaccatcagtgaccttgatgtttataagtttcgtctcctgtatcaacaacaccagaccaaacgcccccaaatcatgatttatgatgtcagtaagccgcctcgagggtcttntgactcgtcttcgtctcggcctcgacggttctagcaacgctcggtccctccccgtntaaccctnttccgtcgtccgggtcctacccggnggtacgtggaacgggtacccggagtaccgttagtaaccgtttaagtttcgttacggtacgttacgtttacaagttaacgggaacctaacggtacgaacggtcctaacccggttccggttacccggttaccgtttaccggttaaccggggtaaaccgggttaccggggtaacccgttaaaccggggtcccctacccgggtttaccccgttaccgggtaccgaccccggtaacccggaaaccccgggaccccctaaacccccgttcgttacccccg

SEQ ID NO: 149610 - DNA, 704 bp, Homo sapiens
  misc_feature: GYAE6OF01AHGKI.24.81.H04.1.454.CMB.1.raw
  modified_base (311)..(311): a, c, t, g, unknown or other
  misc_feature (311)..(311): n is a, c, g, or t
tcagactactatgtcacgaccggtgctcgatttagtagtgtagattcgcggggggggtctcagggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatcctcctgccactgcaaccatcagtcgaccttgatttgtttataagtttgtctctggtactcaacaacacccaggacaaacgcccccaaactcatgtatttanagatgtcagtaactccggccctcggagggtccttcgtgtacgttccgtcttcgtcgtggcctccgacggtctcggaccgtaaccgtaccggtccctcccgtacgaccctacgttccgtccggtcgggtccctaccggacgggtacgtacgggaacgggtaccggtaagggtccgtacgttaacctttagtttacgttccggtacttacgtttaccgaagttacgggaaaccaggacctacggaccgtaccggttcccggttacccggacgtttacggtaacgggtaacgggtaaccgggaaccgttaaccgggtacccgtacccggttcccgggtacccggtacgaacccggtacccgaacccgtaccccaaccccgtcgttacgttaccccg

SEQ ID NO: 149611 - DNA, 767 bp, Homo sapiens
  misc_feature: GYAE6OF01ACLQW.24.81.H04.1.454.CMB.1.raw
  modified_base (129)..(129): a, c, t, g, unknown or other
  misc_feature (129)..(129): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactnagggcacgagggtcctgggcccagtctgccctgactcaacctgcctcgtgtcgtgggtctcctggacagtcgatcaccatcctcctgccactcgaccaacctatcagttcgaccttgattgtttaatacgttttcgcttccgtggtactacgaaacctaaccacccgaggaccaaaccgaccccctaaatctagtacgtaattactgtatcgtacgtaagttaaccgtccggtacccgtcggtacgggtacttcgtacggacttccggtctttccgtacggttcggtcctaccggtacggttacgtacggtaaccgaacccggtacccggtaccccgtcccggtacgtaccctacttcccgtcggtaccgggtccctacggtaacgggtcgtaagggtacgttagtcgggtacggtacttacgggaacttttagttagtaccgtacgtacgtactactaacggttcgactaccggtaacgtaaccgttaccggtaccgttacgtccggttacgttacccggggttaaccggtagggtacccgggtacggtaacgttcccggggtaaccctaccggtttacccggttaccccgggacaaacccggtaacccccgaaacccggtaccccgtaaaccccgg

SEQ ID NO: 149612 - DNA, 761 bp, Homo sapiens
  misc_feature: GYAE6OF01CC8S0.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcacctatcctcctgccacgtgacctaaacctatacgagtcgtaacctttgacttagtttattaagtttgtactcgttggtactacaaacctaacacccgaggaccaaacgaccccctaaacgtactactacgtatttacgtgtaacttggtaaccgtaacggttaacgtcccggtacccgtaccggaacggggttccttacgtcgtagtccgtctttcgtactcggtaccgtcgtacggtcgtcgtaacctaccgtacccggtcctcccgtacgacctacgtccgtcgttacgggtccgtaacgacgggtcgttacgggacggtacgtaacggcgttacgtaacggttattacgttacgacgttagttaccgtaacgtaccgggtaacaacggacgtaacggcccgtaaggttaacccgttccggttacggttaaccggttaacggggtaaaccgggtaccgggtaaccccgtaggttacccggtaccccgttcgggtcccggtaccgaacccggtacccaaccccggaaccccgttaacccgtaacgtaccggttacccg

SEQ ID NO: 149613 - DNA, 601 bp, Homo sapiens
  misc_feature: GYAE6OF01A3SQJ.24.81.H04.1.454.CMB.1.raw
  modified_base (251)..(251): a, c, t, g, unknown or other
  misc_feature (251)..(251): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaacatcagtcgaccttgattgttataagttntctctgtatacaacacaccagacaacgaccccaactcgatgtatttactgatgtactaagtaactccggacctcgacggggtcttcgtagtactcgtcttctcgtcgcgtcgaggtctggacctaccgacggtccctcctacgactactcgtacgcggtcctcgagtcgtacgtacggacgaggtcgtaggtacttagttacgtcgtacgtacgtacgtagtacggtaacaacggtcgtacgccgtaagttcccgtcggtaccttcggtaggtaccgtacggacgtacggtccctacggtcgccggttacaccggtacccaacggtaccccaaccgtcctcggttacccg

SEQ ID NO: 149614 - DNA, 773 bp, Homo sapiens
  misc_feature: GYAE6OF01DBUAX.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactgacaaccatcagtcgtaccttgtattgtttatagtttgtctctggtactcaaaccaaccacccaggacaaaccgacccccaaactctatgtatttagtgatgtacaagtaacgtccggcccgtcggacggggtcttcgtgtacgttccgtctttcgtcgtcggtcctccgtaggtccgtacggaacccgaaccgtacccgggtccccttacccgtaccgacccttactcccgttaccggtccgggtcctcccggtacgggtcgtacgggaacgggtaccggtacggttccgttacgtaaccgtttaagtttacgttcgtaacggttacgtttaccgaagttaacggaacgtaacggccgtaacggtccggtacgttacccggttccggtaccgtttaccgggttaacggggaaacgggttacccggggtaaacccggtacccgggttacccgtacccccgggtttacccggtaacccgggttacccgaaacccgggtacccccgggaaacccgggtaacccccctaaaccccgtcggtttaccccgtaaccccgg

SEQ ID NO: 149615 - DNA, 713 bp, Homo sapiens
  misc_feature: GYAE6OF01A5BE8.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctctgtatcaacaacaccaggacaaacgccccaaatcatgtatttatgatcgtactagtaatccggtccctcgaggggtcttctgtactccgtctttctctcggcctccgtaggtccgtacggactaaaccgaccggtcccctacccgtcggaaccctacgttccgttacggtcggggtcctaccggtacgggtccgtagggaacgggaaccggtagggtcctacggtaacttagtttaacgtcgtacgttacgttacgtaaggtacggaacgaacggacctacggtacgtaacgtccggttacccgggtccgttaccggtttacgggtaaaccgggttaccggggtaaacccgtaaccgggttacccggtaaccccgggttcccgttacccgggtaccgtaacccggtaacccccgaaaccgggtacccccaaaccccgtaaccgttccggtaaccccg

SEQ ID NO: 149616 - DNA, 683 bp, Homo sapiens
  misc_feature: GYAE6OF01D96IW.24.81.H04.1.454.CMB.1.raw
  modified_base (535)..(535): a, c, t, g, unknown or other
  misc_feature (535)..(535): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatcctcctgcactgaccaacattcagtcgaccttgattagtttagtagtttgtctcgtgtatacaacacacgagaccaacaccccaatctaatgtattactatatcgtactagtaacgtcggtcccgtaggtacgggttctcgtacgtcttcgtccgttcgtcggtcgtccgtaccgtaggtcgtaccggaacaacccgtccggtccccttccgtacgtacctagttccggtacgtcgggtacctccggtagggtcgtacgggaacggtcgggaacggttcctaaggtacctttaagtttactaggtaccttagtccgtaggaaccganaacggtcgagcccggttagcccgttacgggtcgttacggaacgggtcggtaacggtaaccgacggtaccccgttaccggtcccgttcggtaacccgaacccggtaacccgtaacccggtaccccgtacccgtagtaccccgttacccg

SEQ ID NO: 149617 - DNA, 596 bp, Homo sapiens
  misc_feature: GYAE6OF01BQXGD.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgaccaaccatcagtcgaccttgattgtttataagtttgtctcctggtatccaacaaccacccaggaccaaaacgccccccaaaatccattgtaactttatgattgtcagtaacgtccggccctacgaggggcttctgtatcgcttctcgtggctccaggtctggcaacgcgtcctccctcgacacttcctcgtgggcctccaggtcgtgacgggacgacggtctagtacttattattgtactagtttccaagttcggaacaagtcgagtcctagtccttaccggcttcggttaccggaggttacgggaacctacgggtaccacccgtccgtaccgtaccgacgtaccccgaaggcccccaaaccgtccgtcgtaccccg

SEQ ID NO: 149618 - DNA, 831 bp, Homo sapiens
  misc_feature: GYAE6OF01DSKSM.24.81.H04.1.454.CMB.1.raw
  modified_base (205)..(205): a, c, t, g, unknown or other
  misc_feature (205)..(205): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcacntctctgcactgaccaacatcagtcgtaccttgactttagtttaatagttttctcgttccgttaggtactacaaacaaccacccgacggacaaaccgacccccaaactccaagtagtaactttagtagagttacgtacgaagttaacgtcccgggaccgtccggtacgggggttccttcgtcgaacgttccgtcctttccgttacgttcgggccttacccgaagggttcctacggtacctaaccggacccgtcccgtcccgttacgaccttacgtccgtcgtacggtaccgtcccgtacgggtcgtacggggaacgggaccgggacgtaccggtagtttaaccgttaagttttacgtttcggaacgtttaccgtttacgtacggtaacgggttaaccgaaacgtcgtaaccggtaccggttaccgttttacccgggttccccggtacggtttacccgggttaacgggggttaaacggggttaacccggggtaaacccggttaaacccggggttaccccgttaaccccgggttacccggttacccgggttacccgtaaacccgggtacccccgtaaaccccggaccccccggttaaaccccgtcccggttaacccggttaacccccgg

SEQ ID NO: 149619 - DNA, 590 bp, Homo sapiens
  misc_feature: GYAE6OF01A32GB.24.81.H04.1.454.CMB.1.raw
  modified_base (301)..(301): a, c, t, g, unknown or other
  misc_feature (301)..(301): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgcccccaaactcatgatttangatgtcagtaatccggccctcgaggggtcttcgtgatcgtctttcgtctggcctccgaggtcgtcgctaaccgccggtcctccctagaccctatctcgtcggacctccgaggtcgtaggaggaccggaggtctaggtacttattagttcgctagttcagttacggactaagcagcagtccgtccggtactcggttacggaggttacgggaacccgtacggtaccgtacccggttccgtaccggtcgaaccgccccggaaacggaccccaaccccgtcgtccgttacccg

SEQ ID NO: 149620 - DNA, 884 bp, Homo sapiens
  misc_feature: GYAE6OF01CCCYT.24.81.H04.1.454.CMB.1.raw
tcagactactatgtcacgaccggtgctcgatttagtagtgtagattcgcgggggggtctcaggaggcagcgctctcgggacgtctccaccatggcctgggctctagctattcctcaccctcctcactcaggcacagggtcctgggcccagtctcgccctgactcaacctcgcccccgtgtctcgggtctctggacagtcgatcacctagtcctcctgcctacgtcgaccaaacctatccgagttacgacccgtttggtaatttggttttaaataggttttcgtcctccgttaggttaactaccaaaccaaaccgtacccccgaagggaaccctaaaaccgtacccccccaaaattccaagtttgtaacttttagtcgtaacttcgtactacgttaacgtcccggtacccacggtacgggtccttttacggcgtaccgttcgttacctttcgtaccgtcggtaccctccggtagtccgttaccggacctaacccggcccgttcccgcccgttacgaccctacgttcccgttacggttccgggttaccgagggttacctacgggtacggtaaccggtacggtacgtacgttaacgtttacttaaggttccgtacgtttacgtacccgtaaggttaccggaacccgttaaggtacccgtacgggtaacccgtaccgggtttaccccgttaccgggttaccctttaccgggttaaccgggaacggttaaccggggaacccggttaaaacccggttcccggttaacccccggttcccggttaccgggtacccgggaaccccccggttaaaccccggttaaacccccggaaacccccccggttaaccctaacccggttcccgttaaacccgttccccgtttaaccccggg

SEQ ID NO: 149621 - DNA, 568 bp, Homo sapiens
  misc_feature: GYAE6OF01BTNEC.24.81.H04.1.454.CMB.1.raw
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacngtcgatcacatctccngcactgcaacatcngtnaccttgattgtttaatagttntctctgtatacaacaacaccagacaaaccgccccaaactcatatattangatgtacataacgtcggcccgtagtacgggtcttctagacttcgtcttctcgtgtcctcgtagtcgtcgacaccgaccgtccctaccgtgacctctctcgtcgcctcgagcgtaggcgacgagntgtatatatcagtagttacagtcggaatacgactacggcaacggttccgttaccgtaccgttacgggtacgggtaagtaccgggacctaacggtcccgtaccggtccgtcgacgacccggtaccgaccgacccacctcgtcgtaccc

SEQ ID NO: 149622 - DNA, 762 bp, Homo sapiens
  misc_feature: GYAE6OF01ATTJH.24.81.H04.1.454.CMB.1.raw
tcagactactatgtcacgaccggtgctcgatttagtagtgtagattcgcggggggggtctcaggaggcagcgctcgtcgggacgtctccaccatggcctgggctctgctattcctcaccctcctcactcagggcacgagggtcctgggcccagtctgccctgactcaacctgcctccgtgtctgggtctctggacagtcgatcaccatctcctgcactgacaacctatcagtcgtaccttgattagtttataacgtttcgtctctagtatacaaacacaccgaggaccaaacgaccccaaatcaattcgtattagtagtactacgtactaagtaacgtccggtacctacgtagggtccttacgtagtacgttcgtctttacgtcgtacgggtacctcgtaggtcgtcggaaccaaccgtaccggtcccttacccgtacgaaccgtacgttcccgttacggtcggggtacctaccggtaacggggtcccttaaggggaaccgggtaaccggtacgggtacctttagggaacttttaacgtttacgttacggaccgtttaggttaaccgtaggtaacgtaacgaacggtaccgagtacccggtaagttcccgttacccggtacggtttaacccggttaaccggggtaacgggtaaccgggttaaacccgtaaccgggttaccgtaaccccgttccgttaccgggtacccaaccgggtaaccccgaacgggtaaccccctaaccccggtaactccggttaacccc

SEQ ID NO: 149623 - DNA, 718 bp, Homo sapiens
  misc_feature: GYAE6OF01AJ2L4.24.81.H04.1.454.CMB.1.raw
  modified_base (319)..(319): a, c, t, g, unknown or other
  misc_feature (319)..(319): n is a, c, g, or t
  modified_base (394)..(394): a, c, t, g, unknown or other
  misc_feature (394)..(394): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcgaacctgcctccgtgtctgggtctcctggacagtcgatcaccatcctctgcactgccaaccatcagtcgtaccttgattcgtttaataagttttgtcttcgtggtactccaaacaaccaccaggaccaaacgaccccaaactcaatcgtatttancgtatcgtacaagtaactccggccctagacgggtcttcgtgacgttcgtcttcgttcgtcgtactccgtagttcncggtaccaaccgtaccggcccttcccgtacgaccctatccgtcggtacggcctaccgtacggtctaggggtaacggaacggtacggtaccgttaacgtaaccgtttaagtttacgttaaccgcggttaactttcgtaacgtaacgggtaaccaaacggttaccgaaggtacccgtaaggtcccgtttcccgggtctttaaacccgggtcggtaaaacggggtccgggaaacccgtaagggttcccctaaccgggttcccgttaacggtacccgtaccggaaccccggaaccgtacccccgaaacccctcggttcgttaaccccg

SEQ ID NO: 149624 - DNA, 689 bp, Homo sapiens
  misc_feature: GYAE6OF01BIC4J.24.81.H04.1.454.CMB.1.raw
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatccaccatctcctgcactcgcaacntcagtcgaccttgagtttagttttaattaagtttcgttcttccgtaggttactacaaacctaacacccgaaggaccaaacgaccccccaaatcattacgtatttanagtactgtactaagtaaccgtccggtacctggacgggtcttacgtgtacttcgtcttaccgtcgtcggtcctcgacggtcgtacgaccgtaacgaccggtccctaccgtacacccttactccgttacggtcggtcccgttacggtacgtacggtcgggaacggaccggtacggtacgtacgttaacgttatttacgtacgtaccgttagtaccgtaggtaacgaacgtacgacgtacgcgtaacggttccttaccggcgttacggtacgggtaacggtaccgggtaaccgtacgtcccggtaccggtccggtccgtaacgacccgtacccgtaaccgacccgaccctacgtcctaccg

SEQ ID NO: 149625 - DNA, 507 bp, Homo sapiens
  misc_feature: GYAE6OF01CW2J5.24.81.H04.1.454.CMB.1.raw
  modified_base (472)..(507): a, c, t, g, unknown or other
  misc_feature (472)..(507): n is a, c, g, or t
tcagactactatgtcacgaccggtgctcgatttagtagtgtagattcgcgggcgcaccaagtacaaccccctccctcgagagtcgagccagtatatcacctgacacctccatcaaccagttctccctgaaggtgacctctgtgaccgctgcggacacggcatgtattactgtgcgtcgccgacggggcggggtattcgtttgacctccgtggggaccacgggaaccctcggccctacccgtctcctccacgccctcccaaccgaacgggccctacgttcccggtcccttcccccgtggccgccccgttcgcctaccggaggacgccctacccgtccggaaggacgcacgtaccggccggccccgtgggctacggtccgtagggtaaccgaacggtaccttacccttaccaactaacgttaggtacgttcgtaggccggcgggtcgtacggagaacgggtcgactagagcagnnnnnnnnnnnnnnnnnnnnnnnnnnnnnnnnnnnn

SEQ ID NO: 149626 - DNA, 769 bp, Homo sapiens
  misc_feature: GYAE6OF01CJJV1.24.81.H04.1.454.CMB.1.raw
  modified_base (474)..(474): a, c, t, g, unknown or other
  misc_feature (474)..(474): n is a, c, g, or t
tcagactactatgtcacgaccggtgctcgatttagtagtgtagattcgcgggggggggtctcagggaggcagcgctctcgggacgtctccaccatggcctgggctctgctattcctcaccctcctcactcagggcacgagggtcctgggcccagtctgccctgactcaacctgcctccgtgtctgggtctcctggacagtcgatcaccatctcctgcactgacaaccatcagtcgtaccttgattagtttattaagtttgtccttccgtggtactacaaacaaccaccgacggacaaaccgcccctaaactccatagtactttatgtatgtacagtaacgtccgtaccgtcgagggtcttacgtgtacgtcgtcttctcgtacggtcctaccgtacggtcgtcgaccaccgtacccggtccctccctcgaccctacgttcgtccgtcggccgtcgacggcgtcggagggtacgnggtacgtacgttaacttacttaagttcgtacgttacgttagtaacggttacggaacgtaaccggacgtaacggtcggtaacccggtttcccgggttacccggttaccgggttaccgggtttaaccccgggggttaaagggttaaccccggggtaaacccggttaaccggggtttacccccgtaaccccgggtttcccccgggttaccggtaccccgggtaaacccggtaacccccgggtaaaccccggtaaccccccgttaaaccccccggtccggtttacccgtaaacccccgg

SEQ ID NO: 149627 - DNA, 872 bp, Homo sapiens
  misc_feature: GYAE6OF01EZQQ5.24.81.H04.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (332)..(332): a, c, t, g, unknown or other
  misc_feature (332)..(332): n is a, c, g, or t
tcagactactatgtcacgaccggtgctcgatttagtagtgtagattcgcgggggggggtctcaggaggcagcgctctcgggacgtctccaccatggcctgggctctgctattcctccaccctcctcactcagggcacagggtcctgggcccagtctcgcccttgacctcgaacctgcctccgtgtctgggtctccgtggacngtcgatccaccatcctcctagcactcgacaaaccntcgagtgtaccttagatttggtttaattaacggttttgttcctcgtaggttaactacaaaccaacccaccgaggaaccaaaccgaccccaaactnacgtagttatttaactgtagtgttacaagttacgtccgccgtacggtacgggttcttcgtagtaccgttacgtcctttccgtacgtcggtcctaccgttagggtcccaggacccgaaacccggtccggccccccttacggtaaccgaccctacgttccgtacccggtcgggtaccctcccgggtacgggtcgtaacggggaacggtaccggggtaacgtccgggttaactaaaccggttttacttttaacggtaccggttaaccgttaacgggtttaaccgtaacggaacgggttaaacccggaacggtaccgtaacgggtaacccggttaccgttacccggttacccggggtttaccggtttaaccggtaaacggggttaaacccgggtacggggttaaaaccccggttacggtaacccccggtaaccccgggtttccccgtacccggggttaacccggaacccccgggttaaacccccggttaaccccggaaacccccccgtttaaacccccggtcggttacccccgttaaaccccgg

SEQ ID NO: 149628 - DNA, 831 bp, Homo sapiens
  misc_feature: GYAE6OF01C6Y87.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctccaccctcctcactcagggcacagggtccgtgggcccagtctcgccctgactcaacctcgcctccgtgtcgtgggtctcctggacagtcgactcacactcctcctgcactgaccaaacccattccgagtacgtaccttagtaagtttagttttaagtttaacgttttcgttaccttcgttaggtactaactaaacccaaacccgtaacccgaaccggtaaccgaaaacccccgaaccccccctaaaacttaccgtaacgttagtttaaaccgtttttagtacgtaagttacgtaaccgtaaggttaacccgtccggttaccccgtacgggtacggggttcccttacgtcggtaccgttcgttacctttccgtccgtacggttccgttaccggtacgttaccgtacggtaacccgtaacccgtacccgttcccccgtacccgtaccgtaaccctcttacccgttcggtaccggtccgtacccggtcgggtacgtacgggacggacgtacggtactacgtacgtttaagttcgtacgtcgttcgtaccgtagtacgggaactaacgcgtaccgtacggtccttacccggtcgttaccgtaccgggttaacggaacgggtcggaacccgtaaccggtacccgttaccccggtcgttcccgtaaccggacccgaacccccggtaaccgacccccgtaaccccgtcgttaccgttacccccg

SEQ ID NO: 149629 - DNA, 769 bp, Homo sapiens
  misc_feature: GYAE6OF01CC71J.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccatcagtcgaccttgattgtttaattaagtttgtcttcctggtactacaaacaaccacccaggacaaaccgacccccaaactacatagtactttatgtatcgtactaagtaacgtccggtacccgtacggtacggggtcctttcgtagtacgttccgttacctttcgtcgttcgggccctacgtacggttccgtacggtaccctaaaccgcccggtccccttaccccgtacgtaaccctaacgttccgttccggtacggggtacccttacccggtaggggtacccgtagggaaacgggaccggtacgggtacttacggttaaactttactttacggttcgaccggttagttactagggttaacggaaccaaggtaccgagtacccgtacgggttacccgttccgggttaccctttcgggttaaccggggtaccggtaacgggaacccggtacggtacccctaaaccccgggttccgtacccggtaacccgtaccccggtaacccgtaacccggacccccgtaaacccctcggttcccgtaccccg

SEQ ID NO: 149630 - DNA, 688 bp, Homo sapiens
  misc_feature: GYAE6OF01BSH2L.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctcggcccctggactaccaacctcgcctccgtgtcgtcgggtcctcctgggactgtcgatccaccatcctcctagctatcgaccaaacctatcgtagtcgtaccgttagagttgtttaatagtttcgtacttcgtgtactaccaacaaccaccgagaaccaaccgacccctaaactcgattacgtattacgtagtatgtacgtaagtacgtccggtccctagggtacgggttctcgtcggttactccgttccgtcttacgtccggcctacgtggacgtcggaccgaaccgtccgtccctcccgtactaccctagtcgtacgtcggtccgtccgacgtagtacggaggacggtaggtacgtagtacgttagttgtacgtacgttactagtacgacggacaacgtcgagacgtacgtccgttccgtcggttaccggtaacggtacggtaccggtaccggtaccggtcccgtacggttcccgttaccggaccggtaccgtaacccggaccgacccctaaacgtcccgttacgtacccg

SEQ ID NO: 149631 - DNA, 743 bp, Homo sapiens
  misc_feature: GYAE6OF01DCCJK.24.81.H04.1.454.CMB.1.raw
  modified_base (568)..(568): a, c, t, g, unknown or other
  misc_feature (568)..(568): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctcgtgtctgggtctccgtggacagtcgactcaccatctcctgcactcgccaaccatcagtcgtaccttgtattgtttaacttaggtttgttccttccgttggttactacaaaccaaccacccgaaggaccaaacccgacccccaaactccaagttagtaatttatacgtattcgtacgtacggttaacgtccgggtacccttcggacggggtccttacgtacgtacgttccgtctttcgttccttcggtcccttccggtacggttccgtcgggaaccaaccgggtaccggtccccgttaccctaccgtacctacttccgttccggtcgggtcctacccggacggtcgtagggaacgggaacggcggtcgtacggtaactttagtttagttaccgtnttaacggttctaagggtaccgaacgtaagaccgacgtcctacggttcccgttccggtccgttaaccgggttcgggtaaaccgggttcgggaacccgtacggttacccgtacccggttccggtaccggtaccaccgggtaaccccacggtacccctaacccgtcgttccgtaaccc

SEQ ID NO: 149632 - DNA, 634 bp, Homo sapiens
  misc_feature: GYAE6OF01C3G5B.24.81.H04.1.454.CMB.1.raw
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccntcagtgaccttgatgtttatagttgtctctgtatcaacaacaccaggcaaacgccccaaactcatgtatttangatgtacagtaagtccggcctgacgggtcttcgtgatcgtcttctcgtcggctccgagtcgtcggacaaccgtcgccctcctacgacctactctcgtcggtcctccgacggtctacggacggaccggacggtctacggtacttagttagttcgtactagttctagttacggaacaacgtcgacgtcgtacggttcccgttaccggtcgttaccggttacgggtaacgggtacgggtaaccgtaacgggttcccgtaccccgggttcccggttaccgggtacccgacggtaacccccggaaccggaccccctaaaccccgtcgttccggtaaccccg

SEQ ID NO: 149633 - DNA, 689 bp, Homo sapiens
  misc_feature: GYAE6OF01AXXLM.24.81.H04.1.454.CMB.1.raw
  modified_base (541)..(541): a, c, t, g, unknown or other
  misc_feature (541)..(541): n is a, c, g, or t
  modified_base (649)..(649): a, c, t, g, unknown or other
  misc_feature (649)..(649): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcgagggcacgaggggttcctgggcccagtctcgccctgactcaactgcctcgtgtctgggtctcgtgcagtcgatcacatctcctgcactgacaaccatcgagtcgtacttagactttagtttaattaagtttcgtctcgtgtactacaacaacgaccacgacaaaccgacccctaatcatactaagtttatacgtagtagtacgtaacgtaaacgtcccggcccgtacggtaacggggttcttaaccgttcgtaacgttccggtacttccgtacgttacgggcctacgtacggttacgtcggacccaacgtacccgtcccgttacctaccggacctacgttacgccgtacgggtacctacggacgggtacgacgggtaacgggtacgaaggtccttagtaacttacgtttanacgtctaaggttcgtagacgaacacggactacgcggtactccgtaccgcgtttaccggtaacggtaggtaaccgggaagtccggtaaccgtccggtccgtcggaaacncccggaaaccgtacccggacccaacccgtagtcgtaaccc

SEQ ID NO: 149634 - DNA, 687 bp, Homo sapiens
  misc_feature: GYAE6OF01AJNMQ.24.81.H04.1.454.CMB.1.raw
  modified_base (325)..(325): a, c, t, g, unknown or other
  misc_feature (325)..(325): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgccctcgtgtctgggtctccgtggacctagtcgactccaccctatccgtcctgcacgtgaccaaaccatcagtcgtaccttgattagttttataagtttcgtcgtcctggtatacaacaacacccaggacaaaccgcccccaaatcatgtatttanagtatagtactagtaactccggccctcgagggtccttgtacgtctccggttcttccgtcgtcgtccctacggtacggtcgacgtaccgaccgacccggtccccttccgtaccgacccgtacttcccggtggtcccggtccgttaccggacgggtacgtaacgggacgggaaccggtcgggtaccttaaggtacctttagttactacggtacttaggtaccgtaagtccggaaactacggtcgacgtacgtctcccggttccggtacgttccggtaggtaacggtaccggacgtacccgtaccggtacctcccggtacgtcgacccggtacccaccgacccctaccgtccgtccgttaacccg

SEQ ID NO: 149635 - DNA, 505 bp, Homo sapiens
  misc_feature: GYAE6OF02HPZPK.24.81.H04.1.454.CMB.1.raw
  modified_base (498)..(498): a, c, t, g, unknown or other
  misc_feature (498)..(498): n is a, c, g, or t
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgttataagtttgtctcctggtatcaacaacaccaggcaaagcccccaaactcatgatttatgatgtcagtaatcggccctcagggcttctgatcgcttctctggctccaggtctggcaacacggcctccctgaccatctctggctcaggctgaggcgaggctgactatattgctagttcagtggacaagcagcagcttccggctcgttcggagttcgggacctaaggtccaccgtcctcggtcacgcccaaggcccaacccnctgtacc

SEQ ID NO: 149636 - DNA, 518 bp, Homo sapiens
  misc_feature: GYAE6OF02H84N7.24.81.H04.1.454.CMB.1.raw
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgcccccaaactcatgatttatgatgtcagtaatcggccctcgaggggtcttctgatcgcttctctggctccaggtctggcaacacggcctccctgacccatctcgtgggcctcgaggctgacggacgaggctagacttattatgctagttcagttggaacagcagcagtccttccggcttcgttcggagtcggaccaggtccaccgtcctcggcacgcccaaggcccaaccctctgtcc

SEQ ID NO: 149637 - DNA, 495 bp, Homo sapiens
  misc_feature: GYAE6OF02G93G1.24.81.H04.1.454.CMB.1.raw
  modified_base (490)..(490): a, c, t, g, unknown or other
  misc_feature (490)..(490): n is a, c, g, or t
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgatttatgatgtcagtaatcggcctcagggcttctgatcgcttctctggctcaggtctggcaacacgcctcctgaccatctctgggctccgaggctgaggacgaggctgactattattgctagttcatggacagcagcagtcttccgctcgtcggagtggaccaggtccaccgtctcggtcacgccaaggcccaacccntctac

SEQ ID NO: 149638 - DNA, 508 bp, Homo sapiens
  misc_feature: GYAE6OF02G16W5.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaatcatgatttatgatgtcagtaatcggccctcagggcttctgatcgcttctctggctccaggtctggcaacacggcctccctgaccatctctgggctccaggctgaggacgaggctgacttattattgctagttcagtggacagcagcagcttcggctcgttcggagtggaccaaggtccaccggtcctcggtcacgcccgaaggcccaaccctctcgtacc

SEQ ID NO: 149639 - DNA, 553 bp, Homo sapiens
  misc_feature: GYAE6OF02HTTHK.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgcccccaaatcatgatttatgatgtcagtaactcggccctcgaggggtcttctgacttcgtcttcttcgtcggctccgaggttctggaccaaccgaccggccctcccgtcgaccctattcctcgtcgggcctccgaggcctgacgggcgaggcttaggaactttattattgctagttcagtacggacagcagcagtctcggctcgttcggagtcgggaccgaaggtccaccgtcgtccggtcacggcccaacggccccaacccgtctcgtaccc

SEQ ID NO: 149640 - DNA, 497 bp, Homo sapiens
  misc_feature: GYAE6OF02HDWX1.24.81.H04.1.454.CMB.1.raw
  modified_base (358)..(358): a, c, t, g, unknown or other
  misc_feature (358)..(358): n is a, c, g, or t
  modified_base (492)..(492): a, c, t, g, unknown or other
  misc_feature (492)..(492): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaatcatgatttatgatgtcagtaatcggcctcgagggcttctgatcgcttctctggctcaggtctggcaacncggcctcctgaccatctctgggctccgaggctgacggacgaggctagacttattatgctagttcagtggacagcagcagcttcgctcgtcggagtcggacaaggtccacgtctcgcacgccaaggcccaacccntgtcc

SEQ ID NO: 149641 - DNA, 514 bp, Homo sapiens
  misc_feature: GYAE6OF02I9HI9.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcaggggcttctgatcgcttctctggctcaggtctggcaacacggcctccctgaccatctctggctccaggctgaggacgaggctgactattatgctagttcatggaacagcagcagtcgtccggctcgttcggagtcgggacctaaggtccaccgttccgtcggtcgacgcccgaaggcctcgccccctggtcc

SEQ ID NO: 149642 - DNA, 404 bp, Homo sapiens
  misc_feature: GYAE6OF02FUP7M.24.81.H04.1.454.CMB.1.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (387)..(404): a, c, t, g, unknown or other
  misc_feature (387)..(404): n is a, c, g, or t
tcagactactatgtcacgaccggtgctcgatttagtagtgtagattcgcgggtcggcaccaagtacaacccctccctccgagagtcgagccagtactatcacctgacacctccatcaaccagttctccctgaaggtgacctctgtgaccgctgcggacacggccatgtattactgtgcgtgccaccgggcggggagttcgtttgacgtcctggggccagggaaccctggccaccgtctcctcagcctccacaaagggcccatcggtccttccccctggccnccctgcctccaggagcacctccgagagcacngcgccctgggctgcctggtccaagactaccttccactatacgtagtcctgacgcgggctggcaaggcgcgatagnnnnnnnnnnnnnnnnnn

SEQ ID NO: 149643 - DNA, 496 bp, Homo sapiens
  misc_feature: GYAE6OF02I4WE2.24.81.H04.1.454.CMB.1.raw
  modified_base (489)..(489): a, c, t, g, unknown or other
  misc_feature (489)..(489): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggcctcagggcttctgatcgcttctctggctccaggtctggcaacacggcctcctgaccatctctgggctccaggctgaggacgaggctgactattatgcagttcatggacagcagcagcttccgctcttcgagtggaccaaggtccacgtctcgtcagcccaaggcccaacccnctgtacc

SEQ ID NO: 149644 - DNA, 404 bp, Homo sapiens
  misc_feature: GYAE6OF02F7V0T.24.81.H04.1.454.CMB.1.raw
  modified_base (377)..(404): a, c, t, g, unknown or other
  misc_feature (377)..(404): n is a, c, g, or t
tcagactactatgtcacgaccggtgctcgatttagtagtgtagattcgcgggcggcaccaagtacaacccctccctcgagagtcgagccagtatatcacctgacacctccatcaaccagttcctccctgaaggtgacctctgtgaccgctgcggacacggccatgtattactgtgcgtgccaccgggcggggagttcgtttgactcctggggccagggaaccctggccaccgtctcctcagcctccaccaagggcccatcggtcttccccctggcgccctgctccaggagcacctccgagagccacagcgccctgggctgcctggtcaaggactaccttccgacatagtagtctgagcggctggcaaggcgcatagnnnnnnnnnnnnnnnnnnnnnnnnnnnn

SEQ ID NO: 149645 - DNA, 521 bp, Homo sapiens
  misc_feature: GYAE6OF02I6ERD.24.81.H04.1.454.CMB.1.raw
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagccccccaaactcatgatttatgatgtcagtaatcggcctnagggcttctgatcgcttctctggctcagtctggcaacncgcctcctgaccatctcgtgggcctccgaggctggacggacgaggctgacttattatgctagttcagtggaacagcagcagtcttccggctcgttcggagtcgggacctaaggtccaccggttcctcggtccacgcccgaacggcccaaccccgctcgtacc

SEQ ID NO: 149646 - DNA, 508 bp, Homo sapiens
  misc_feature: GYAE6OF02GNKMX.24.81.H04.1.454.CMB.1.raw
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
  modified_base (500)..(500): a, c, t, g, unknown or other
  misc_feature (500)..(500): n is a, c, g, or t
tcagactactatgtcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcaggggcttctgatcgcttctctggctccaggtctggcaacacggccctcccngaccatctctcgggctccgaggctggaggacgaggctgactattattgctagttcatggacagcagcagcttccgntcgtacggagtgggaccaaggtcaccgtctcggtcacgcccaggcccaacccnctcgtacc

SEQ ID NO: 149647 - DNA, 498 bp, Homo sapiens
  misc_feature: GYAE6OF02JEVCM.24.81.H04.1.454.CMB.1.raw
tcagactactatgtcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgatttatgatgtcagtaatcggcctcagggcttctgatcgcttctctggctccagtctggcacacggcctcctgaccatctctgggctcgaggctgaggacgaggctgactattatgctagttcatggacaagcaagcagctccggctcgttcggagtggaccaaggtccacgtcctcggtcacgcccaaggcccaacccactgtacc

SEQ ID NO: 149648 - DNA, 508 bp, Homo sapiens
  misc_feature: GYAE6OF02IXV81.24.81.H04.1.454.CMB.1.raw
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgttataagtttgtctctggtatcaacaacaccaggcaaagcccccaaactcatgatttatgatgtcagtaatcggccctcgaggggcttctgatcgcttctctggctccaggtctggcaacacggcctccctgaccatcctctcgggctccgaggctggacggacgaggctgactattattgctagtcatggaacagcagcagtcttccgntcgttcggagtggaccaaggtccacgtctcgcacgcccaaggcccaacccnctcgtacc

SEQ ID NO: 149649 - DNA, 515 bp, Homo sapiens
  misc_feature: GYAE6OF02HDLK0.24.81.H04.1.454.CMB.1.raw
  modified_base (511)..(511): a, c, t, g, unknown or other
  misc_feature (511)..(511): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaacgcccccaaactcatgatttatgatgtcagtaatcggccctcgagggtcttctgactcgcttctctggctccaggtctggcaacgcggcctccctgaccatctcgtcgggcctccgacggctaggacgggacggaggctgaacttattattgctagttcagtggaacagcagcagtcctcgctgtcggagtcggacaaggtccaccgtctcgtcacgccaggcccacccngctc

SEQ ID NO: 149650 - DNA, 519 bp, Homo sapiens
  misc_feature: GYAE6OF02IHXCL.24.81.H04.1.454.CMB.1.raw
  modified_base (511)..(511): a, c, t, g, unknown or other
  misc_feature (511)..(511): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaaactcaatgatttatgatgtcagtaatcggccctcaggggcttctgatcgctttctctggctcaggtctggcaacacggcctccctgaccatctctgggctcagctgaggacgaggctgacttattattgctagttcagtggacagcagcagtcttccggctcgttcggagtcggaccaaggtccaccggtcctcggtcacggacccaacggccccaacccnctcgtacc

SEQ ID NO: 149651 - DNA, 500 bp, Homo sapiens
  misc_feature: GYAE6OF02FNXBM.24.81.H04.1.454.CMB.1.raw
  modified_base (445)..(445): a, c, t, g, unknown or other
  misc_feature (445)..(445): n is a, c, g, or t
  modified_base (495)..(495): a, c, t, g, unknown or other
  misc_feature (495)..(495): n is a, c, g, or t
tcagactactatgtcacgaccggtgctcgatttagtagtgtagattcgcgggggggggtctcaggaggcagccgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggcctcaggggcttctgatcgcttctctggctccaggtctggcaacacggcctccctgaccatctcgtgggctccaggctgaggacgagctgactattatgctagttcagtggacagcagcagcttcgntctggagtggaccaaggtcaccgtctcggtcacgcccaaggcccaacccntgtcc

SEQ ID NO: 149652 - DNA, 555 bp, Homo sapiens
  misc_feature: GYAE6OF02GLJDF.24.81.H04.1.454.CMB.1.raw
  modified_base (320)..(320): a, c, t, g, unknown or other
  misc_feature (320)..(320): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctgtatcaacaacaccagcaaacgcccccaaactcatgatttatgatgtcagtaatcggccctnaggtgcttctgatcgcttctctggctcgaggtctggcaacaccggccctccctgaccatcctcgtgggctccgaggctggaggacgaggctgacttattattgctagttcagtggacaagcagcagtccttccggcttcgttacgggaacggttcgggaaccctaaggtcctaacccggttcccgttccgggtaccaccggaccccgaaacgggacccctaaccccgcttaccgg

SEQ ID NO: 149653 - DNA, 513 bp, Homo sapiens
  misc_feature: GYAE6OF02IM4PE.24.81.H04.1.454.CMB.1.raw
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgttataagtttgtctctggtatcaacaacaccaggcaaacgcccccaaatcatgatttangatgtcagtaatcggcctcgagggcttcngatcgcttctctggctccaggtctggcaacncggccctccctgaccatctcgtgggcctccgaggctggacggacgaggctgacttattatgctagtcatggacagcagcagctcggctgtcggagtggaccaggtccaccgtcctggtaccacggacccaacggccccaaccccgtatcgtacc

SEQ ID NO: 149654 - DNA, 514 bp, Homo sapiens
  misc_feature: GYAE6OF02H2J25.24.81.H04.1.454.CMB.1.raw
  modified_base (504)..(504): a, c, t, g, unknown or other
  misc_feature (504)..(504): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgcccccaaactcatgatttatgatgtcagtaatcggcctcagggcttctgatcgcttctctgctccagtctggcaacacggcctcctgaccatctctgggctccgaggctgacggacgcggctgactattatgctagtcatcggacagcagcagcgttccgctcgttggacgtgggacctaaggtccaccgtcctcggtcacggcccgaaggccccaaacccncgtcgtaccg

SEQ ID NO: 149655 - DNA, 528 bp, Homo sapiens
  misc_feature: GYAE6OF02H99W1.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactgcaaccatcagtgaccttgattgtttataagtttgtctcctggtatcaacaacacccaggcaaacgcccccaaactcatgatttatgatgtcagtaatcggccctgagggtcttctgatcgcttctctggctcgaggtctggcaacacggcctccctagaacctatctcgtcgggcctccgaggctgacggacgaggctgacttattatgctagtcagtaggaacagcagcagtcctcggctcgtcggagtcggaccaggtccaccggtcctcggtacacgacccgaacggccccaaccctactgtacc

SEQ ID NO: 149656 - DNA, 530 bp, Homo sapiens
  misc_feature: GYAE6OF02GTB53.24.81.H04.1.454.CMB.1.raw
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagccccccaaactcatgatttatgatgtcagtaatcggccctcgaggggcttcngatcgcttctctggctccaggtctggcaacncggcctcccngaccatctcgtgggcctccgaggctggacggacgaggctgacttattntgctagttcatggacagcagcagtccgttccgcttcgtcggagtcgggacctaaggtccaccggtccgtcggtcaccggcccaacggcccaaccccgactcgtaccc

SEQ ID NO: 149657 - DNA, 520 bp, Homo sapiens
  misc_feature: GYAE6OF02H7YZH.24.81.H04.1.454.CMB.1.raw
  modified_base (367)..(367): a, c, t, g, unknown or other
  misc_feature (367)..(367): n is a, c, g, or t
  modified_base (411)..(411): a, c, t, g, unknown or other
  misc_feature (411)..(411): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggcaaaagccccccaaaatcatgatttatgaatgtcagtaatcggccctcaggggcttctgatcgcttctctggctccaggtctggcaaacncggcctccctgacccatctctgggcctccgaggctggaggacgnggctggacttattatgctagtcagttggaacagcagcagtcctcggcttctcggagtggaccaaggtcaccgtcctcgcacgcccaaggtccccaaccctcgtgtaccc

SEQ ID NO: 149658 - DNA, 562 bp, Homo sapiens
  misc_feature: GYAE6OF02IM5D8.24.81.H04.1.454.CMB.1.raw
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (437)..(437): a, c, t, g, unknown or other
  misc_feature (437)..(437): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacacccaggcaaagcccccaaatcatgatttatgatgtcagtaatcgcctcagggcttctgatcgcttctctggctccaggtctggacaacacggcctccctgaccatctctcggccncgcgtcgnggacggagacgtgagtacttattatgacgtatatagacggaanacgacagacgacgttccggtcgtacgttcggtacggttacgggacggtaacggtaaccgtaccgtacccggtccgttaccggacgaccgaccgaacccggacccaacccgtacgtacgttaaccc

SEQ ID NO: 149659 - DNA, 588 bp, Homo sapiens
  misc_feature: GYAE6OF02HSC6W.24.81.H04.1.454.CMB.1.raw
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
tcagactactatgtcacgaccggtgctcgatttagtagtgtagattcgcgggggggggtcgtcaggaggcagcgctctcgggacggtctccaccatggcctgggcgtctgctattcctccaccctcctcactcagggcgacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaacgcccccaaatcatgatttatgatgtcagtaatcggccctgaggggtcttctgatcgtcttctctcggactccagggtctggacaacaccgggtccctccctgaccctatctcgtgggctcgacggctggacggacggacgctagacttattagttcgctagtcagtggaacaagcngacacgtccgttccggnttccgttcgggaaggttcggggaaccgtaacgggtcctaacccgggttcccttaccggggtaccacggccccgtaaaccgggccccctaaaccccctcgttcgtaccc

SEQ ID NO: 149660 - DNA, 558 bp, Homo sapiens
  misc_feature: GYAE6OF02F7ATK.24.81.H04.1.454.CMB.1.raw
  modified_base (303)..(303): a, c, t, g, unknown or other
  misc_feature (303)..(303): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaacgcccccaaactcatgatttangatgtcagtaatccggccctcgaggggtcttctgatcgtcttctctggcctccgaggtctggaccaacgaccggtccctcccgtcgacctatcctcgtcgggcctccgagggtcctaggacggacggacggcttaggacttagtttacttgactagttcagtggaacagcagcagtcttcggcttcgtacggagtcgggactaggtccaccggtcctcggcacggacccgaacggcccaaccccgtagtcgtacc

SEQ ID NO: 149661 - DNA, 523 bp, Homo sapiens
  misc_feature: GYAE6OF02I3I6I.24.81.H04.1.454.CMB.1.raw
  modified_base (452)..(452): a, c, t, g, unknown or other
  misc_feature (452)..(452): n is a, c, g, or t
  modified_base (516)..(516): a, c, t, g, unknown or other
  misc_feature (516)..(516): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccagcaaagcccccaaactcatgatttatgatgtcagtaatcggcctcaggggtcttctgatcgtcttctcgtggctccgaggtctggacaacacggccctccctgaccattccgtctcgggctccgaggtctggacggacgaggctagactattagttgctagttcatggacagcagcngtctccggctcgtaggagtggacgtaaggtccaccgtcgtcgtcacgccaacggcccaacccgntcgtacc

SEQ ID NO: 149662 - DNA, 506 bp, Homo sapiens
  misc_feature: GYAE6OF02IWN5E.24.81.H04.1.454.CMB.1.raw
  modified_base (415)..(415): a, c, t, g, unknown or other
  misc_feature (415)..(415): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgaatttatgatgtcagtaatcggccctcgagggcttacgtgatcgtcttctctcggctccaggtctggacaacacggcctccctcgaccatcctctcggctccgaggctgaggcgaggctnacttattatgcagtcagtgacaagcagcagtctcggctgtcggagtggaccgaagtccacgtctcgtnacgccaacgcccaaccnctctac

SEQ ID NO: 149663 - DNA, 511 bp, Homo sapiens
  misc_feature: GYAE6OF02ITUYZ.24.81.H04.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (441)..(441): a, c, t, g, unknown or other
  misc_feature (441)..(441): n is a, c, g, or t
  modified_base (506)..(506): a, c, t, g, unknown or other
  misc_feature (506)..(506): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtnaccttgatgtttataagtttntctcctggtatcaacaacacccaggcaaacgcccccaaactcatgatttatgatgtcagtaatcggcctcgagggcttctgatcgtcttctcgtgctcagtctgacaacgcgcctcctcgacactctcgtcggctcgaggctggacggacgaggctgtactattagtgctagtcagtgacagacagcgngtcgtcgtctcgtagagtcggacgagtaccacgtcgtcgtcgacgaccgacgacccaccctcgtntaccg

SEQ ID NO: 149664 - DNA, 520 bp, Homo sapiens
  misc_feature: GYAE6OF02G4988.24.81.H04.1.454.CMB.1.raw
  modified_base (356)..(356): a, c, t, g, unknown or other
  misc_feature (356)..(356): n is a, c, g, or t
  modified_base (516)..(516): a, c, t, g, unknown or other
  misc_feature (516)..(516): n is a, c, g, or t
tcagactactatgtcacgaccggtgctcgatttagtagtgtagattcgcggggggggtctcaggaggcagcgctctcgggacgtctccaccatggcctgggctctgctattcctcaccctcatcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcgaggggcttcgtgatcgcttctctggctcaggtcnggcaacacggcctccctgaccatcctcgtgggcctccgaggctggacggacgaggctgacttattattgctagttcagtcggacagcagcagtctccgcttcgtcggagtcgggacctaaggtccaccgtccgtcggtacacggcccaacggcccacccntccg

SEQ ID NO: 149665 - DNA, 539 bp, Homo sapiens
  misc_feature: GYAE6OF02HK258.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggcctcagggcttctgatcgcttctctggctccaggtctggcaacacggcctccctgacccatctctgggcctccgaggctggagacgaggctgacttattattgctagttcagtggaactaagcagcacgtcttccggcttcgttacgggagttcgggaccctaagggtccacccggttcctccgggtaccacgtccccgaaaggccccaacccctgtcgtaccg

SEQ ID NO: 149666 - DNA, 378 bp, Homo sapiens
  misc_feature: GYAE6OF02IJX1G.24.81.H04.1.454.CMB.1.raw
  modified_base (371)..(378): a, c, t, g, unknown or other
  misc_feature (371)..(378): n is a, c, g, or t
tcagactactatgtcacgaccggtgctcgatttagtagtgtagattcgcgggcgcaccaagtacaacccctccctcgagagtcgagccagtatatcacccgacacctccatcaaccagttctccctgaaggtgacctctgtgaccgctgcggacacggccatgtattactgtgcgtgccaccgggcggggagttcgtttgactcctggggccagggaaccctggccaccgtctcctcagcctccaccaagggcccatcggtcttcccctggcgccctgctccaggagcacctccgagagcacagcggccctgggctgcctggtcaaggactacttcacatagtagtctgagcggctggcaaggcgcatagnnnnnnnn

SEQ ID NO: 149667 - DNA, 605 bp, Homo sapiens
  misc_feature: GYAE6OF02HBMDS.24.81.H04.1.454.CMB.1.raw
tcagactactatgtcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgttatagtttgtctctggtatcaacaacaccaggcaaacgcccccaaactcatgatttatgatgtcagtaatcggccctcgaggggtcttctgtactcgtcttcgtcgtggcctccgaggttcgtggaccaaccgaccggcccttcccgtacgaccctatccgtccgtggggcctcccggaggtccgtagacgggaccggacggtctagtaaccttattacttcgactagttcagttacgggaacaagtcagcgacgtccgttccggtcttacgtacgggtacgtcgggaaccgtaaggtccgtaacccggttccgtccggtaccaccggacccgaaccgggacccctaaccccgtacgtacgtaccc

SEQ ID NO: 149668 - DNA, 509 bp, Homo sapiens
  misc_feature: GYAE6OF02JEZ3X.24.81.H04.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (505)..(505): a, c, t, g, unknown or other
  misc_feature (505)..(505): n is a, c, g, or t
tcagactactatgtcacgaccggtgctcgatttagtagtgtagattcgcgggggggtcgtcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaaacaaacacccaggcaaaagcccccaaaatcaatgaatttatgatgtcagtaatcggccctnaggggcttctgatcgctttcncgtggctccaggtctggcaacacggcctccctgacccatctcgtgggctaccaggctgaggacaggtctggactattatgcagttcatggacaagcagctagcttcggntnttcggaatggacaaggtcacgtcngtnagcccaaaggccaaccctangtac

SEQ ID NO: 149669 - DNA, 527 bp, Homo sapiens
  misc_feature: GYAE6OF02GXAA2.24.81.H04.1.454.CMB.1.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (516)..(516): a, c, t, g, unknown or other
  misc_feature (516)..(516): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgatttangatgtcagtaatcggcctcgaggggcttctgatcgcttctctggctcagtctgcaacncgcctcctgacntcnctggcctcaggctgaggacgngctgactattatgctagttcagtcggaacagcagcagcttccggctcgtacggacgtcgggaccgtaagggtcctaccggtccgtacggttcacggtcccgtaaacggcccccaacccgtntaccggtaccc

SEQ ID NO: 149670 - DNA, 507 bp, Homo sapiens
  misc_feature: GYAE6OF02GRSOC.24.81.H04.1.454.CMB.1.raw
  modified_base (362)..(362): a, c, t, g, unknown or other
  misc_feature (362)..(362): n is a, c, g, or t
  modified_base (402)..(402): a, c, t, g, unknown or other
  misc_feature (402)..(402): n is a, c, g, or t
  modified_base (468)..(468): a, c, t, g, unknown or other
  misc_feature (468)..(468): n is a, c, g, or t
  modified_base (499)..(499): a, c, t, g, unknown or other
  misc_feature (499)..(499): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgatttatgatgtcagtaatcggcctcgaggggcttctgatcgcttctctggctccaggtctggcaacncggcctcctgaccatctctgggcctccaggctgaggacgnggctgactattattgctagttcatggacagcagcagcttcgcttcgttcggagtggacaaggtccnccgtcgtcgtgacgcccgaaggcccaacccnctcgtacc

SEQ ID NO: 149671 - DNA, 543 bp, Homo sapiens
  misc_feature: GYAE6OF02IEBDD.24.81.H04.1.454.CMB.1.raw
  modified_base (375)..(375): a, c, t, g, unknown or other
  misc_feature (375)..(375): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaagcccccaaactcatgattttatgatgtcagtaatcggccctgaggggtcttctgactcgcttctctggctccaggtctggcaacacggcctcccngaccatctcgtggcctcgagctgaggacgaggctagacttattagttcgctagttcagtgaacagtcaacgcaagtccgttccggcttcgttacggagtcgggacctaacgggtccacccggttccgtacggtcacggacccgacggaccccaacccgtctcgtaccc

SEQ ID NO: 149672 - DNA, 631 bp, Homo sapiens
  misc_feature: GYAE6OF02IAEIP.24.81.H04.1.454.CMB.1.raw
  modified_base (374)..(374): a, c, t, g, unknown or other
  misc_feature (374)..(374): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatctcctgcactgcaaccatcagtcgacttgattgttatagtttgtctcctggtactcaacaacaccagcaaagcccccaaatcatacgtatttagtgatgtacgagttaatccgggccctacggaggggtcttcgtgtactcgtcttctctggcctcgacggttcnggactaacgccgtccctcccgtgacctacgtctcgtcgggcctccgaggccgtaggacgaccgaggtctagttaacttagtttacgtggtacttagttaccagttacggaaacgaacgtcgaagtccgaagtcccgtttccggtaccttcggttacggggaggttacgggaaccgttaacgggtaccgtacccggttcccgttaccggtaccgacgtccccggaaacggtccccccaaccggtaccgtcgtaacccg

SEQ ID NO: 149673 - DNA, 513 bp, Homo sapiens
  misc_feature: GYAE6OF02IXHZR.24.81.H04.1.454.CMB.1.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaagcccccaaactcatgatttatgatgtcagtaatcggccctcaggggcttctgatcgcttctctgctcagtctgcaacncgctccngaccatctctggctcagctgaggacgngctgactattatgctgttcatggacagcagcagtcttcggcttcgttacggagtcgggaaccgaaggttccaccggtccgtcggtacgacgcccaacggacccaaccccgtactcgtacc

SEQ ID NO: 149674 - DNA, 543 bp, Homo sapiens
  misc_feature: GYAE6OF02FE6W6.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttatagtttgtctcctggtatcaacaacacccaggcaaacgcccccaaactcatgatttatgatgtacagtaatccggcctgagggcttctgactcgcttctctggctcaggtctggacaaccgcggccctccctgaccatcctcgtgggcctcgaggcgtggacggtacgaggctagactattattgctagtcagtgacagcagctagccttcggcttacgtacggtagtacgggacctaagggtcctaccgggtccttcggtaccacgaccccgaacggaccccacccgactcgtaccc

SEQ ID NO: 149675 - DNA, 503 bp, Homo sapiens
  misc_feature: GYAE6OF02JMMLA.24.81.H04.1.454.CMB.1.raw
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (417)..(417): a, c, t, g, unknown or other
  misc_feature (417)..(417): n is a, c, g, or t
  modified_base (495)..(495): a, c, t, g, unknown or other
  misc_feature (495)..(495): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagttttgtctcctggtatcaacaacacccaggcaaagccccccaaactcaactgatttatgatgtcagtaatcgcctcagggcttcgngatcgcttctctgctcagtctgcaacacgcctcctgaccntctctggctccgaggctgaggacgaggctgacttattatcgntagttcagtgacagcagcagctcgctacgtgagtcggacgaggtcacgtctcgaccgacgcccgacgacccaaccctntcgtaccg

SEQ ID NO: 149676 - DNA, 493 bp, Homo sapiens
  misc_feature: GYAE6OF02I2RK5.24.81.H04.1.454.CMB.1.raw
  modified_base (405)..(406): a, c, t, g, unknown or other
  misc_feature (405)..(406): n is a, c, g, or t
  modified_base (408)..(408): a, c, t, g, unknown or other
  misc_feature (408)..(408): n is a, c, g, or t
  modified_base (410)..(411): a, c, t, g, unknown or other
  misc_feature (410)..(411): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (430)..(431): a, c, t, g, unknown or other
  misc_feature (430)..(431): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (444)..(445): a, c, t, g, unknown or other
  misc_feature (444)..(445): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(454): a, c, t, g, unknown or other
  misc_feature (452)..(454): n is a, c, g, or t
  modified_base (456)..(465): a, c, t, g, unknown or other
  misc_feature (456)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (472)..(474): a, c, t, g, unknown or other
  misc_feature (472)..(474): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (487)..(488): a, c, t, g, unknown or other
  misc_feature (487)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
tcagactactatgtcacgaccggtgctcgatttagtagtgtagattcgcggggcgcaccaagtaccaaccctccctaccgagagtcgagccagtatatcaccccgacacctccatcctaaccacgttcctcctgaaggtggacctcgtgtgaccgcttgtcgggacacggccatgtacttactggtgccgtgccaccgggcggggagttcgttgactccgtgggccagggaacctggccgaccgtctccgtcagcctccaccgaacgggcccagtcggtctcccctggccgccctgctccaggagcacctcggagacgctacagcggccctgggctgcctggtcgaacggtactactccgactagtagtagtctggagtcgggctcggaccaaggcgacagtagnncncnncnagagtcagngtacgncnngngngngncgngnngcncncnnnannnnnnnnnngntntgnnncncgngngcgcgnntngng

SEQ ID NO: 149677 - DNA, 822 bp, Homo sapiens
  misc_feature: GYAE6OF02HZ52V.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctatttcctcaccctcctcactcagggcacagggtcctgggcccagtctgccctgactcaacctgcctccgtgtctgggtctcctggacagtcgatcacatctcctgcatgcaaccatcagtcgaccttgattgtttataagtttgtctcctggtatcaacaacaccaggacaaacgaccccccaaactcgatagtattttatcgtatgtactaagtaacgtccggccctcgaaggggtcttcgttcgagttccgtcttccttcgtcgggtcctccgacggttcgtacgggtaccaaaccgtaacccgggtcccttaccccgttacggaaccccttaactttcccgtaccggttaccggggccccgtttacccggtaacgggtccgttacgggaaacgggaaccgggtagggaccgttaggtaaaaccgttttaagtttaaacggtttcggtacgtaacggttttaccgtaaaggttacggtaaacccgaaacgggtacccgaacggtacccgtaaaccgggttcccggttttaacccgggacccgttttaccggttttacccggggaaacgggtttaccggggtaaacccccggtaaacgggttaccccgtaccccgggttaaccccggttaccccgggtaaccgtaccccgggaacccccggtaaaccggaacccccccgtaaaaccccgttccggtacccggtttaaccccg

SEQ ID NO: 149678 - DNA, 587 bp, Homo sapiens
  misc_feature: GYAE6OF02IUYXA.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactgcaaccatcagtgaccttgatgttatagttgtctcctgtactcaacaacaccaggacaaacgaccccaaactcatgtattatgatgtactagtaatccggcctacgagggtcttcgtgatcgtcttctctcggctccgtaggtctggacaacgccgccctcctcgtaccactctcgtcggctccgaggtcctaggaacgggacgacgtacgtgtaacttacttaagtgactacgttacgagttagaacagcgacggactacgtccttacggaccttgtacggacggttcgggaaccgtaacggttcccaccggttccggacggtacaccggtacccgaaccggtaccccaaccccgtagtacccgtccg

SEQ ID NO: 149679 - DNA, 599 bp, Homo sapiens
  misc_feature: GYAE6OF02HNFS1.24.81.H04.1.454.CMB.1.raw
  modified_base (335)..(335): a, c, t, g, unknown or other
  misc_feature (335)..(335): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactgccaaccatcagtgaccttgattgtttataagtttgtctcctgtatcaacaacaccaggcaaacgccccaaatcatagtatttatgatgtacaagtaatcggaccctgagggtcttcngatcgcttctctcggtctccgtaggtctggacaaacgccggtccctcccagacctatctcgtcgggcctccgaggtctggacggacgaagggtctagtaacttagttagttgaccgtagtttcaagttacgggaaccaagctagccgtagtccgttccggcttaccggttagggaacggttcgggaacccgtaacggtccgtaaccggtccgtacgggtacaccggaccccgaaacggtaccccaaaccccgtactacggtacc

SEQ ID NO: 149680 - DNA, 560 bp, Homo sapiens
  misc_feature: GYAE6OF02HY4LZ.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacaccaggcaaacgcccccaaactcatgatttatgatgtcagtaatcggccctcgagggtcttctgatcgtcttctctcggctccgaggtctggacaacgccggcccttccctgaccctacttctcgtcgggcctccgaggctggacggacgaggtctagacttattagttgctagtcagtcggaacaagcgagcagtccttccggcttacgttacggaggtacgggaccgtaaggtcccaccggtccgtcggacaccggacccgaaccggcccaacccgtcgtacgtccg

SEQ ID NO: 149681 - DNA, 673 bp, Homo sapiens
  misc_feature: GYAE6OF02JH1ZL.24.81.H04.1.454.CMB.1.raw
  modified_base (299)..(299): a, c, t, g, unknown or other
  misc_feature (299)..(299): n is a, c, g, or t
tcagactactatgtcacgaccggtgctcgatttagtagtgtagattcgcgggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctgtatacaacaacaccagacaaacgccccaatcatgattangatgtacaagtaacgtccggtccctcggagggtcttcgtagactccgtcttctcgtggcctcgaggttctcggacaacgccggtccctcctgacctactcctccgtggcctacgaggtcgtaggaacggacggaggcttagtaactttatttacgttcggacttacggttactaagttacggaacaagtaccacggtaccgtaacgttcccggttaccggtccggtttaccggttaacgggtaaccgggtacgggtaaacccggttaacgggttacccttaacccgggttaccgttaccgggttaaccaacccgggtaaccccgtaaacccgggtaacccccctaaaccccggttccgttaccggttaaccccg

SEQ ID NO: 149682 - DNA, 539 bp, Homo sapiens
  misc_feature: GYAE6OF02HQDFE.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctggtatcaacaacaccaggcaaacgcccccaaactcatgatttatgatgtcagtaatcggccctcgagggtcttcgtgatcgtcttctctggctccgaggtctcggacaaccgcggtccctccctgaccatctcgtcgggcctccgaggtctggacggcgaggctagacttagttattgctagttcagtcggacagcagcacgtctccggcttcgtcggagtcggaccaggtccaccgtcgtccggtcacgcccgaacggaccccaaccccgtgtctaccg

SEQ ID NO: 149683 - DNA, 584 bp, Homo sapiens
  misc_feature: GYAE6OF02H1KA6.24.81.H04.1.454.CMB.1.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (431)..(431): a, c, t, g, unknown or other
  misc_feature (431)..(431): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaaccatcagtgaccttgattgttataagtttgtctcctgtatacaactaacaccaggacaaacgaccccccaaatccatacgaatttatagtatgttcaagtaagtccgccctcgagggtcttctnatcgcttctntcggactcctagttcncggctaaccgacggtccctcctgaccacttctcgtcggcctaccgagcgtagaggacgnggtctaggtactattagtcgactagtctaagtgaacaacgcaacgacgtagtccgttcggtccttcgtacgggaagtcgggaccgtaaggtcctaaccggtcctacggtccacggacccctaaacgggacccctaaccctcgtaccgtacccg

SEQ ID NO: 149684 - DNA, 690 bp, Homo sapiens
  misc_feature: GYAE6OF02IFOJH.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttatagtttgtctctgtatcaacaacaccagcaaacgccccaaatcatgattatgatgtacagttaactccggcccttagacggggtcctttactggtatccgtcttccgtctgggacctccgagggtctagggaccaaaccgaccgggcccttacccgtgaacccgtactcgttccgtcggggcctacccgagggtcctggaacgggaccgagggaccttggtaacttaagtttaagttcggaccttaggtttacaagtacggtaaaccaaggactaacggtacctaacggtcccggttttaaccccggcgttttacccgttaaccggggtaagggttaccgggggaacccctaaaaggggttcccaaccccggtttcccgtaaccggggttaccaacggtacccccgtaaacgggacccccctaaccccgtaaccgtggttaacccc

SEQ ID NO: 149685 - DNA, 529 bp, Homo sapiens
  misc_feature: GYAE6OF02F7FFN.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctggtatcaacaacaccagcaaacgcccccaaactcatgatttatgatgtcagtaatcggcctcgagggtcttctgatcgcttctctggctcagtctgcaacacgcctcctgaccatctcgtcgggctccgaggctgacgggacgagctgtactattattcgctagttcagtgacagcagcagtcttccggcttcgtacggtagtacggaccgaacggtcctacccggttcgtacggtcacggacccgaacggccccaacccgtactcgtaccg

SEQ ID NO: 149686 - DNA, 678 bp, Homo sapiens
  misc_feature: GYAE6OF02GNM63.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctgtatcaacaacaccaggacaaacgcccccaaactcatgtatttatgatgtacagtaacgtccggccctcgaggggtcttcgtagacgtcgcgtttctcgtcggtcctcgaggtctggacctaacgacccggtcctcccgtcgacctacttcgtccgtcgggtacctccgagggtcctggacgggacggtacggtcgtaggttaacctttaagtttacgttcggacctaagtttacaacggttacgggaacctaaggtaccgaggtaccgtaaccggtccgtttcccgggtacttcccggtttaacgggagggttaccgggaaccgtaacgggtacccggttaccccgtccggtaccggtacccgaacccgggtaccccgaaaccgggaccccaaacccccgttacgtaccgtaaccccg

SEQ ID NO: 149687 - DNA, 609 bp, Homo sapiens
  misc_feature: GYAE6OF02GOLH3.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctgtatcaacaacaccaggcaaacgcccccaaactcatgatttatgatgtcagtaatcggccctcgagggtcttctgatcgtcttctctggcctcgaggtctggcaacgcggccctcctcgacctatcctcgtcgggcctccgacgggtctagggaacggacggacgggtctaggtaacttatttagtcggacttacgttcgaagttacgggaactaaggccaaggtccgaacgtcccgttccggcgttaccggttacgggaacggtcggggaacctaacgggtcctacccggtcccgtacggtaccaaccggcccgaaaccgggacccctaaaccccgtcgttaccgtacccg

SEQ ID NO: 149688 - DNA, 708 bp, Homo sapiens
  misc_feature: GYAE6OF02GHZT6.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctctgtatcaacaacaccaggacaaacgacccccaaactcatagatttatgatgtcagtaactcggccctcgaggggtcttcgtgtactcgtctttctcgtcggcctccgtaggttctcggaccaaccgtaccggtcccttaccccgtcgaaccctacttcccgttccggtcgggtcccttcccggagggtcgtacgggacgggaccggtacggtccgtacgtaacgttatttaacgttcggtacttacggtttcaacgttagggaaccaacggtaccgaacggtccgtacgttacccgtttcccgggtaccgtttaccggttacgggtaccgggtacggggtaaccccgtaaaccgggttcccgtaaccccgggtttcccggttaccgggtacccgaaccggtacccccggaaacgggtaccccccaacccccgtacggttacccgttaccccg

SEQ ID NO: 149689 - DNA, 685 bp, Homo sapiens
  misc_feature: GYAE6OF02GCJNN.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaaccaccaggcaaacgcccccaaactcatcgtatttatgatgtacagtaactccggacccttgacgggtcttcgtgtactcgtcttcgtcgtcggtcctaccggtaggttcgtggacctaaaccgaccggtccccttaccgtcgaaccctattccgttcgtcggggtaccttccggacggtccgtacggtaacgggaaccggacgggtccgtacgtaacgtttaagtttaacgttcgacgttacgttaccgtagttaaccgggactaaacggcgaacgtccgtaacgttcccgtttccggtaccgttaccgttaacggggtaacgtccggggtaaccctaacgggttccctaacccgggttccttaccgggacaccggacccgtaaaccgggacccctaacccctaggtcctaacccg

SEQ ID NO: 149690 - DNA, 557 bp, Homo sapiens
  misc_feature: GYAE6OF02JEEH4.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtctcctgtatcaacaacacccaggcaaacgcccccaaactcatgatttatgatgtcagtaactccggccctcgaggggtcttcgtgacttcgctttctcgtcggcctccaggtctggccaacgacggtccctacccgtcgaccctattcctcgtacgggcctccgaggctggacggacggaggctagacttattacttgctagttcagtgactagcagcgacgtcttcggctcgttacggagtcggaccgtaaggtccgaccgtccgtacggtcacgcccgaaccgcccaaccctcgtcgtacc

SEQ ID NO: 149691 - DNA, 719 bp, Homo sapiens
  misc_feature: GYAE6OF02JLRO9.24.81.H04.1.454.CMB.1.raw
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (433)..(433): a, c, t, g, unknown or other
  misc_feature (433)..(433): n is a, c, g, or t
  modified_base (686)..(686): a, c, t, g, unknown or other
  misc_feature (686)..(686): n is a, c, g, or t
tcagactactatgtcacgaccggtgctcgatttagtagtgtagattcgcgggggggggtcgtcgaggaggcgagcgctctcgggacgtctccaccatggcctgggctctgctattcctcaccctcctcactcaggcacagggtcctgggcccagtctgccctgactcaacctgcctccgtgtctgggtctccgtggacagtcgatcaccatctcctgcactgccaaccatcagtcgtaccttgattgtttataagtttcgtctcttggtactcaaacaacaccagacaaacgacccccaaatcatagtaactttangtatggtactagtaacgcgtcctcggagggtcttcganatccgtcttgtccgttacggctaccgtaggttcgtacgaccgtaacgcccggtccctacccgtacgaacctacgttccnccggttacgggtcccctaccggtacggccttaggggaacgggtaccggacggtcttacgggtaacctttaagtttacgggttaccgacgtttacggttactaaggtaaccgggtaacaacgggtcctacgaaaccgtcgttaccccgggtttccgcgtttaccgttaaccgggggagtacccgggaacggtaaccggttccgtacccggttcccggtaaccgggttacccggtaacccgaccccgggtaaacnccccccggttaaaccctcggttacccgtacccg

SEQ ID NO: 149692 - DNA, 698 bp, Homo sapiens
  misc_feature: GYAE6OF02G8N5Z.24.81.H04.1.454.CMB.1.raw
  modified_base (196)..(196): a, c, t, g, unknown or other
  misc_feature (196)..(196): n is a, c, g, or t
tcagactactatgtcacgaccggtgctcgatttagtagtgtagattcgcggggggggtcgtcgaggaggcagcgctcgtcgggacgtctccaccatggcctgggctctgctattcctcaccctcctcactcaggcacagggtcctgggcccagtctgccctgactcaacctgcctcgtgtctgggtctcctggacngtcgatcacatcgtcctgccatcgccaaacatcaacggtcgaccttgattgttttataagttttcgtctctggtatactaacaacaccacggacaaccgaccccaaactccaactagaactttagtacgtatagtactaagtaactcggtaccgtcgacgggtcttcgtagtacttcgtaccttcgtctcggtcctacggtaggttcgtacggtacgaaaccgtccggcccttacccgtcgtacctacgtccgtcgtcgggtcctaccgcggtccgtaggtacgggacggtacggtcctaggttaacgttacttagtcggtacgttacgtacgttacgtgggtaaaccaagaccgtaacgacgtacgttcccgtccgggtacttacgggttaccgggttaacggacgggtacccggtaaacggtacccgtaaccggtcccgttaccgggaacgtacccggacccgaacccggtccccggaaaccctacggtcccgtaacccg

SEQ ID NO: 149693 - DNA, 703 bp, Homo sapiens
  misc_feature: GYAE6OF02I1YQI.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcaggcacagggtcctgggcccagtctgccctgactcaacctgcctccgtgtctgggtctcctggacagtcgatcaccatctcctgcactgcaaccatcagtgaccttgatgtttatagttgtctctgtatcaacacaccagacaacgccccaaactcatgatttatgatgtcaagtaactcggcctcgagggtcttcgtgtactcgtcgttctcgtcggccttccgtaggttctacgggtaccaaccgacccgggtcccttaccccgtcgtaaccctacttcccgtccggtcggggtcccttacccggaacgggtccgttacgggaacgggtaaccgggaacgggtccgttaacggtaaccgtttaagtttaacgtttcggtaaccgttacggtttaacctaaggttacgggaaaccgtaaacggtcgaaggtacccaacgtttcccgttacccgggttcttaccgttaccggggtaacggttcggggtaacccgtaagggtcccgtaacccggtcccggtcggtaccgacccggtacccggaaccggaccccaaccccgtaggtcccgtaaccc

SEQ ID NO: 149694 - DNA, 565 bp, Homo sapiens
  misc_feature: GYAE6OF02I8CP8.24.81.H04.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatctcctgcactgcaaccatcagtnaccttgattgtttattaagtttttcncctgtatcaacaacaccaggacaaacgccccaaactcatgatttatagatgtcagtaatccgaccctgagggcttctgtactcgtcttctcgtggcctccgaggtctcggaccaacgtaccggccctcccgtcgacctactccgtcgttcggcctccgacgggtctgggaagggtaccgtagggccttagacttatttacgttagcgtattcagtaggacaagcagcagtcttccggcttcgtacgtagtacggactacggctaccggtcctggccacgccgacgacccacccacttcgacctaccg

SEQ ID NO: 149695 - DNA, 618 bp, Homo sapiens
  misc_feature: GYAE6OF02HHIYV.24.81.H04.1.454.CMB.1.raw
  modified_base (252)..(252): a, c, t, g, unknown or other
  misc_feature (252)..(252): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccatcagtcgaccttgattgttatagttntctctgtatacaacacaccagacaacgaccccaactcatgtatttatgatgtcagtaactccggaccctcgagggtcttctgtatcgtcttctcgtgtcctcgagtctacggacaaccgaccgtccctcccgtacgaccctactcgtaccgtcgggtcctccgaggtccgtaggacgggacgacggtactagtacttaagttagtcgtactacgttctaggtacggaaccgaagtaccgagaccgtacgttccgtccgtacgttccgtacgggtaggtacgggaaccgtaacggtacccgtacccggtccgttaccggtaccgaccgtacccggaaccggacccctaacccgtacgtccgtacccg

SEQ ID NO: 149696 - DNA, 727 bp, Homo sapiens
  misc_feature: GYAE6OF02F5IN0.24.81.H04.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
tcagactactatgtcacgaccggtgctcgatttagtagtgtagattcgcggggggtcgtcaggaggcagcgctctcgggacgtctccaccatggcctgggctctgctattcctcaccctcctcactcaggcacagggtcctgggcccagtctgccctgactcaacctcgcctcgtntctggtctcctggacngtcgatcactatctcctgcactgccaacntcgatgaccttgatgtttatagttgtctctgtatcacaacaccagacaagccccaactcatcgtattactgatgtcacgtaatcggtacctcgtacgggcttcgtgacttccggtcttcgttcgtcggtcctaccgtacgggtcttacgggacctaaaccgtcccgggaccccttacccgttcggaacccctacggtttaccttccggttacggggtcccctcccggtaacgggtccgttaccggaaacggggtacccggaacgggtcccgtttagggtaaacttaaccggttttaagttccgaaccgttaacgggtttacaaacggtttgggtaaaccaaccggtccgtaagacccgtaagtcctttcccgggaacttccgttaagggtaccggtagggaaccccgtttaacgggaaccctacccggggtttacccctacggtcccggtaaccggtcccccgttaaacgggcccccttaaacccccggtcttacgtaacccccgg

SEQ ID NO: 149697 - DNA, 637 bp, Homo sapiens
  misc_feature: GYAE6OF02ID1L9.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctgtatcaacaacaccagacaaacgcccccaaactcatgtatttatgatgtacagtaatccggccctacgaggggtcttactggactcgtctttccgtctcggctccacggttcgtcgggtcaaccgaccggtcccttcccgtcgaccctatcctcgtcgggtcctccgaggtctggacgggtcggacggtctacggtaactttatttattcgctagttacagttaggaacgtagacgacgcgacgtccgttacccggtcgttaccgttcggtacgggtaccgggtaccgtaaacgggttcccgtaacccggtccggtttaccggccgtaaccggtccccggaaaccgggtacccccaaaccccgtcgtaccgtaaccccg

SEQ ID NO: 149698 - DNA, 506 bp, Homo sapiens
  misc_feature: GYAE6OF02HPXUE.24.81.H04.1.454.CMB.1.raw
  modified_base (421)..(421): a, c, t, g, unknown or other
  misc_feature (421)..(421): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtcttcctggtatcaacaacacccaggcaaagcccccaaactcatgatttatgatgtcagtaatcggccctcgaggggcttcgtgatcgcttctctggctcaggtctggcaacacggcctccctgaccactctcgtgggtctcgaggctggaggacgagctgacttattnttgctagtcagtggacagcagcagtcttcggcttcgtcgagtcggacaggtcacgtctcgcacgccaacgccaacccactgtacc

SEQ ID NO: 149699 - DNA, 739 bp, Homo sapiens
  misc_feature: GYAE6OF02HQQ3N.24.81.H04.1.454.CMB.1.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (464)..(464): a, c, t, g, unknown or other
  misc_feature (464)..(464): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacgagggtcctgggcccagtctgccctgactcaacctgccctccgtgtctgggtctccgtggacagtcgatccaccagtcctcctgcactgaccaaacntcagtgaccttgattgtttaatagtttgtctctggtatcaacaacgaccaggacaaaccgcccccaaatcatgtattangatntacataacgtccgacctcggacggtcttcgtagacttccgtctttacgtctcggtcctaccgtaggtcgttaggaccgtaacgccggtccctaccgtacgaccgtactcgtccggtcggcctaccgagtcgtacggacgggtaaccgngggtacccttagggtaaaccttttagttaacgttcggtaaccgtacgttaccggtaagttacggggaaaacgttacccgacgggaacgtaacccgggtagtttccccggttacccgttaaccgtttccgtttaaaccgggggtaaaccgggtccgggttaaacccggaacgggttacccgttaaccccggtccgttaaccgggttaccgaacccggttacccccggaaaccgggttacccccccaaaacccggtacccgtttggttaaacccccg

SEQ ID NO: 149700 - DNA, 683 bp, Homo sapiens
  misc_feature: GYAE6OF02HF9UE.24.81.H04.1.454.CMB.1.raw
  modified_base (262)..(262): a, c, t, g, unknown or other
  misc_feature (262)..(262): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagttgtctctggtatnaacaacaccaggcaaacgcccccaaactcatagtatttatgatgtcagtaactccggccctcgtaggggcttctgtatcgtactttctcgtcggctccgtaggtctggcaacgcggtcctaccctcgacctactccgtcgtcgggcctcgaggcgtacggacgggacgacggtccgttagtacgtttaagtttacttggtacctaggttacctaagttaccgggaacgaaacgggtccgaacggccgtaaccggttccgtttacccgggccgtttacccggtttaccggggtaacgggttaccggggtaacccgtaaacggggttacccgtacccgggtttacccggtacccgggttacccgacccggtaccccggaaacccgggtacccccaaacccccggttacgttaccgtaaccccg

SEQ ID NO: 149701 - DNA, 643 bp, Homo sapiens
  misc_feature: GYAE6OF02H78UO.24.81.H04.1.454.CMB.1.raw
  modified_base (334)..(334): a, c, t, g, unknown or other
  misc_feature (334)..(334): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactgcaaccatcagtgaccttgattgtttataagtttgtctctgtatcaacacaccagacaaacgccccaaatcatgtattatagatgtacagtaatccgacctcgacgggtcttcgngattcgcttcgtcgtcgctccgaggttctacggccaaccgaccgggtcccttcccgtagtaccctacgtttccgtcgttccgggccttacggacggtccgtaggacgggacgaggtctagtactttattagtgtctagttactagttacggaactagccgaagccgtacgtcccgtttaccggccttacgggttaccggaaggttacccgggtaacgtaacgggttacccgtaccggttccccgtacggtacccgaacggacccccgtaaaccgggtacccccaaaccccgttaccgtacggtaacccc

SEQ ID NO: 149702 - DNA, 799 bp, Homo sapiens
  misc_feature: GYAE6OF02GHAJ4.24.81.H04.1.454.CMB.1.raw
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtccctgggcccagtctgccctgactcaacctgcctccgtgtctaggtctcctggacagtcgatcaccatctcctgcactgcaaccatcagtgaccttgattgtttataagtttgtctcgtgtatcaacaacaccagacaaacgaccccaatnactagtatttangatgtactagtaacgtccgtccgtcgtagggtccttgtgtactcgtctttctcgtcggtcctacgtacggttcgtcggacctaaccgacccggtcccttacccgtacgaaccctacttccgttccggtcgggtaccctccgggtaacgggtcgtagggaaccgggaaccggtacggtcgttaacgtaaacgtttaagttttacgttacggtaccgttagtttaccgaggttaaacgggaactaaacgggtccgaacgtaccgttaaccgggttccccgttttacccgggttaccgttttaccgggttaaccggggttaacgggttaacccggggtaaacccggttaaacccggggtttaccccgttaaaccccccgggggtttacccggttacccggggtaacccggttaaaccccggggaaccccccggttaaaacccgggtaacccccccgtaaaaccccccggtttacgttacccccgggtttaaaccccc

SEQ ID NO: 149703 - DNA, 733 bp, Homo sapiens
  misc_feature: GYAE6OF02JZGRD.24.81.H04.1.454.CMB.1.raw
  modified_base (393)..(393): a, c, t, g, unknown or other
  misc_feature (393)..(393): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtcctcctggacagtcgatcaccatctcctgcactgccaaccatcgagtcgaaccttgattgtttataagtttgtctctgtatcaacaacaccagacaaacgcccccaaatcagtcgaatttatacgtattacggtacaaggttactaccggtaccctacggacggggtccttcgacggtagtccgtctttcgcgttcggccttaccgnggtcgtcggaccacgccggtacccgttccgtacggaacctctccgtaccgtgggtacctaccggacgggtactacgggaacggtaccggtaggtacccgtcggttaaaccttagtttacgttaccgggtacttaaggtttacccggtaagttaccggttaaaccggaacgttccgtaaacgggccgttaaaccggggttcccttaacccggttcgtaccgggttaacggggtaaggtacccggggtaaaccgtacggttaccccgaccgggttcccgtaccgggtacgtaccccggaacccgttacccgaccccggttaaaccccgtcgttacccggtcc

SEQ ID NO: 149704 - DNA, 713 bp, Homo sapiens
  misc_feature: GYAE6OF02HPSHQ.24.81.H04.1.454.CMB.1.raw
  modified_base (237)..(237): a, c, t, g, unknown or other
  misc_feature (237)..(237): n is a, c, g, or t
tcagactactatgtcacgaccggtgctcgatttagtagtgtagattcgcgggggggggtcgtcgaggaggcgagcgctctcgggacgtctccaccatggcctgggctctgctattcctcaccctcctcactcagggcacgagggtcctgggcccagtctcgccctgactccaacctgcctccgtgtctgggtcctccgtggaccagtcgatcaccatcctcctgcactgaccaaccntcagtcaccttgattgttataagtttgtctccgtgtactacaacaacaccagaacaaaccgaccccaacttcgatacgtaattatcgatctacgtagtaacgtccggaccctacggtacgggtaccttgtacggtacgtcgtcccgtttctcggttcgtctaccggttaggtaccgtacggtaccgtaaaccgtcccggtcccgttaccccgtacggtaacccttacgtcccttcgggtcggttcccggtaccgacgggtcgttacggaccgggtacggacggtcgttaacgtaacctttattacggttagtccgtacgtttaccaggtacgtaaacgacgacgtaacggcgtaacggttcccgtcgggtaccttcgggtacgggtaacggttaccggtaaccggacggttacgacccgttcgggtacccgacgaccgtaccggaaccgtaccccgaacctaccggtctaacccgg

SEQ ID NO: 149705 - DNA, 589 bp, Homo sapiens
  misc_feature: GYAE6OF02IERYY.24.81.H04.1.454.CMB.1.raw
  modified_base (215)..(215): a, c, t, g, unknown or other
  misc_feature (215)..(215): n is a, c, g, or t
  modified_base (339)..(339): a, c, t, g, unknown or other
  misc_feature (339)..(339): n is a, c, g, or t
  modified_base (491)..(491): a, c, t, g, unknown or other
  misc_feature (491)..(491): n is a, c, g, or t
  modified_base (583)..(583): a, c, t, g, unknown or other
  misc_feature (583)..(583): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctncactgacaaccatcagtcgaccttgattgtttataagtttgtctcctgtactcaacaacaccagacaaacgccccaactcatgatttatgtatgtacagtaactcggacctcgacgggtcttcngtatcgtcttcgtcgtcggcctccgaaggttcgtacggaccaacgacccggtccctaccctacgtaaccctacttacctcggtcgggaccctccggaggtcgtaggaacgggacgaggtccttagtactttaagttattcgtactagttacngtaggacagcagctacgtctcgcttacgtacggagtacggactacggtccaccgtctacggtaccacggacccgaacggaccctaaccgtcncgtacc

SEQ ID NO: 149706 - DNA, 565 bp, Homo sapiens
  misc_feature: GYAE6OF02FKOND.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcacatctcctgcactgcaaccatcagtgaccttgatgtttataagtttgtctcctggtatcaacaacacccaggcaaacgccccccaaactcatgatttatgatgtcagtaatcggccctcgagggtcttcgtgatcgcttctctggctccgaggtctggcaacgacggcctccctgaccatccgtcgtcgggtctccgacggctggacggacgacggctagtactagttactgtctagttcagttggaacaggcagcgacgtccttccggcttcgttacgggagtacgggaccgtaaggtccgacccggtccgtccggtacgaccggtacccaaacggccccaaccccgtacgtcgtacccg

SEQ ID NO: 149707 - DNA, 685 bp, Homo sapiens
  misc_feature: GYAE6OF02I1TTD.24.81.H04.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (224)..(224): a, c, t, g, unknown or other
  misc_feature (224)..(224): n is a, c, g, or t
  modified_base (404)..(404): a, c, t, g, unknown or other
  misc_feature (404)..(404): n is a, c, g, or t
tcagactactatgtcacgaccggtgctcgatttagtagtgtagattcgcggggggtctcaggaggcagcgctctcgggacgtctccaccatggcctgggctctgctattcctcaccctctcactcagggcacagggtcctgggcccagtctgccctgactcactncctcgtntctggtctcgtaggactgtcgatcacctatctcctgcctactgccaaacctntcgtagtcgtaccttagatttagttttaattaaggttttcgtccttccgttggtaactactaaacgaaccaccgtaggaacaaaccggacccccaaacgtcaagtcggtaatttagtagtaactgtacgtaagttaacgtccggtccctacggtacgggtctttacgtagtactccggtnttccgtcgtcggtcttaccgaggtcgtggaactacgaccgtccctcgtacgactcgtcttcggtacggcctacggaggtcgtagggaacggtacggaacggtctaacgttaacttacgtttaagtcgacgttaacgttccgtaggtcgtaaacgaacgacgtacaccgttacgtccgttaccggtccgttacgttacgggaggttacggaaccgtaacggttcctaaccggtcccgttacggcgtaacacccggtaaccgcctaacccgtgttacctaccg

SEQ ID NO: 149708 - DNA, 890 bp, Homo sapiens
  misc_feature: GYAE6OF02I1FFO.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttaattaagtttcgtacttcctggttactactaaaccaaccacccaggaccaaaccggaccccccaaaactccaattacgtaacttttagtacggtagttcgtacgtaacgtaaccgttccggtaccccgttacggaacgggggtctttaccgtagtaacgtccggtctttcctcgttcggccttaccggaggttcgtcggaccgtaaaccgacccgggtccccttacccgtaccggtaaccctacgtttacccgtccggttaccggggtacctcccggtacggggtaccgttacggggaacgggtaaccgggaccgggtaccgttaacggttaaccgttttaacgttttacggtttaaccgtaccgggtttactttaaccggtacggttaacgggtaaaccgaaacgggtaccgtaacggtacccggtaaccgtttcccgggtttaccccgggtaccgtttaccgggtttaaaccggggaacgggtttacccgggggtaaacccggttaaacccggggttaccccgggtttaaccccgggttaccccggttacccggggtaaccttaacccggggtaccccccggtaaaaccggtaaccccccccggtaaacccccggttaccggttacccggtttaaacccccgg

SEQ ID NO: 149709 - DNA, 555 bp, Homo sapiens
  misc_feature: GYAE6OF02H6SU5.24.81.H04.1.454.CMB.1.raw
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactgccaaccatcagtgaccttgatgtttatagtttgtctctgtatcaacaacaccagcaagccccaatcatgattatgatgtcagtaactcgacctcgngggtcttcgtgatcgtcttctctcggctccgtaggtncggacaacaccggccctccngaccactctctcggctccgaggctaggaggacgngtcgtagacttattagttcgctagttcattcggaacgagcgagcacgtccttaccggctacggttggtacgtacggacctaacgggtacctaccggttccgtacggtccgacggacccgacggtaccccgaaccgtaccgtcgtacccg

SEQ ID NO: 149710 - DNA, 735 bp, Homo sapiens
  misc_feature: GYAE6OF02IJVLD.24.81.H04.1.454.CMB.1.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
tcagactactatgtcacgaccggtgctcgatttagtagtgtagattcgcgggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtnacttgatgttatagttntctctgtatacaacaacaccgagacaaacgacccccaaactctatagtaatttagtagtatagtacgtaacgtaagtccggtccctacggacggggtccttacgtcgtacgtccgtacctttctcgttcggtaccgttaccgtaggttacgtaggaccgtaaaccgacccggtaccccttacccgtacggaacctacgttccgttaccggtcgggtacccgtaccggaacgggtccgtaagggaccggggaacggtacgggtaccgttaggtaactttaagtttaacgttcgaacgttaccgttacgaacggtaggaaccaacggtacacgggccgtacgggttccgttaccgggtccgtttacgttaccggggtaaggtccgggaaaccgttaacgggtaccccgtaaccggttcccgtaccgggtaaccgacccgggtaacccgtaacccggacccccgtaaaccccgtcgtaccgtaacccg

SEQ ID NO: 149711 - DNA, 667 bp, Homo sapiens
  misc_feature: GYAE6OF02IBLX7.24.81.H04.1.454.CMB.1.raw
  modified_base (225)..(225): a, c, t, g, unknown or other
  misc_feature (225)..(225): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcaggcacagggtcctgggcccagtctgccctgactcaacctgcctccgtgtctgggtctcctggacagtcgatcaccatctcctgcactgacaaccntcagtcgaccttgatgtttataagtttgtctctgtatacaacaaccaccaggacaaacgcccccaaaactcaatgtaatttagtgaatgtacaagtaacgtccggtacctggacgggtcttcgtgtacttcgtacctttcgtcgtcgggtcctaccgtaggtctacggtaccaaacgtccggtaccctccgtacgtaccctattcgtaccgtcgggtaccttccgaacggtctaggtaacgggaaccgacgggtactacggttaactttaagttacgtgtacgtaggttaccaagttacggaacaacgtcgataccgtaacgttccggtaccgtacgtacgttacggaaggttaccgggaaccgtaacgggtacctaccggttcccgttaccggacctaccggacccgaaaccggtaccccaacccctacgtacgtaacccg

SEQ ID NO: 149712 - DNA, 661 bp, Homo sapiens
  misc_feature: GYAE6OF02HID0C.24.81.H04.1.454.CMB.1.raw
tcagactactatgtcacgaccggtgctcgatttagtagtgtagattcgcgggggggggtctcagggacggcagcgctctcgggacgtctccaccatggcctgggcgtcctgctattcctcaccctcctcactcagggcacgagggtcctgggcccagtctgcccgtgactcaacctgcctccgtgtctgggtctcctggacagtcgatccaccatcctcctgcactgacaaaccatcgagtcgaccgttgattgttaataagtttgtctcctggtactacaacaacaccaggcaaacgcccccaaatcatgatttatgtatcgtcgtagtaacgtccggtccctagacggggtcttctggtacttcggtccttcgtctggtcctaccgaggtctcggaccaacgtccggtccctcccgtacgacccgtagttccgtacgtcgggtcctaccgacggtctcggaacgggaccgaagggtcctacgtaaccttagttactcgacgttacggttaccaagttccggaacacgtacaacggtcgtacgttccgttccggccgttacggttaccgggacggtaccgggaacccgtaacggtacccgtacccggtccgaccgttacgaccggacccgtaaccggcccctaacccgtcgtcgtacccg

SEQ ID NO: 149713 - DNA, 583 bp, Homo sapiens
  misc_feature: GYAE6OF02FR9OH.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttatagtttgtctctggtatcaacaacaccaggacaaacgcccccaaactcatgatttatgatgtcagtaatccggcctcgagggtcttgtgatccgtctttctctggcctcgtaggtctcggacaccgacggtccctcctcgaccattcctcgtcggtcctcgacggctaggacggacgcggtcgtagtaacttagtttattcgactagttacagttcgaacagcagctacgtccttcggcttacgtacgggtaggtacgggaaccgtaggtcccgtacccggttccgtcggtaccgaccgtacccgaaccggtccccaaccccggtactccgtaacccg

SEQ ID NO: 149714 - DNA, 708 bp, Homo sapiens
  misc_feature: GYAE6OF02GA5IC.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaaccatctcctgcactgcaaccatcagtgaccttgattgtttaataagtttgtctcctggtatcaacaaccaccaggacaaacgccccaaactcatgtactttatgattgtacaagttaactccggccctacgtacggggtcttcgtagtactcgtcttctcgtcggtcctccgagggttcgtacggacctaaaccgacccgggtacccttaccccggtacgtaacccgtaacttcccgttccgtcgggtacctacccggacgggtaccgtacgggaacgggtaaccggtacgggcgttacgtaacgtttaactttacgttacgtactaacggttacaagtacgggtaactacggacgtacgacgtaccgtccgtttacccggtacgttaccggttaccgggtacggtacgggtaaccgtaacgggttacccgtaacccggttcccgtaccggttaccaccggtacccgaaaccggacccctaaccccgtacgtccgttaacccg

SEQ ID NO: 149715 - DNA, 710 bp, Homo sapiens
  misc_feature: GYAE6OF02JW292.24.81.H04.1.454.CMB.1.raw
  modified_base (311)..(311): a, c, t, g, unknown or other
  misc_feature (311)..(311): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcaggcacagggtcctgggcccagtctgccctgactcaacctgcctccgtgtctgggtcctcctggacagtcgatcaccatccgtcctgcactcgacaaccatcagtcaaccttgattgtttaataacgtttgtctctggtactcaacacacccaggactaacgaccccaaatcatcgattacngtactgtacagtaactccgcctcgacgggtcttcgagtactcgtacttcgtccgtggtccgtacgtacggtccgtgaccgtaaccaccgggtcccttaccgacgtacctctacccgttcggtaccggccgttaccgacgggtacgtagggtaacgggacggaaccggttcgtaacggttaacttaggtttacgtcgtaacgttagttaccgaaggttaccggaaagtacccggtagtaaccggctaacgttcccggtaccgtaccgggtttaccgttaacgggtaccgtaaccggggtaaccttaccgggtaaccggttcccgtaaccgggttccgtaacccgtaccggtaaccccggtaaccgtaacccccgtaacccggttaccggcctttacccgg

SEQ ID NO: 149716 - DNA, 668 bp, Homo sapiens
  misc_feature: GYAE6OF02H6YRK.24.81.H04.1.454.CMB.1.raw
  modified_base (453)..(453): a, c, t, g, unknown or other
  misc_feature (453)..(453): n is a, c, g, or t
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
  modified_base (556)..(556): a, c, t, g, unknown or other
  misc_feature (556)..(556): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatccaccatcctcctgccactcgaccaacccatcaggtcgtaccttgtattgttttattaagtttcgtctccgttaggtactacaacaaaccaccgaaggacaaaccgccccctaaactcatagttatttatgatgtactaagtaacgtccggtaccctaggcgggttcttcgtagactctcttcgtcgtcgcctcgtaggtctacgaccaaccgccgtccctaccgtcaaccctctcgtccgtggtcccncggacgcgtagggacgaacggcggtactaggtactttattacgttntacgtagtacgtacgtaacggaacacggtacncggtactaaccgtccgttcccggtnttaccgggttaggaccgggtccgggtaaccgtaacggtacccgttaccggtccgtaccggtaccgaacccggacccgaacccggtaccccgtaaccgtcgttacgtaacccg

SEQ ID NO: 149717 - DNA, 687 bp, Homo sapiens
  misc_feature: GYAE6OF02GMLR8.24.81.H04.1.454.CMB.1.raw
  modified_base (444)..(444): a, c, t, g, unknown or other
  misc_feature (444)..(444): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgaccaaccatcaagtcgaccttgattgtttaataagttttcgtctcctggtatcaacaacaccaggacaaacgcccccaaactcagtgtactttatagatgtcaagtaactccggccctacgaggggtcttcgtgactccgtcttactcgtcggtcctcgtacggtcgtcggaccaacgtacccggcccttacccgtaccgaacctactcgtccgtgggcctacgnggcgtaggacggtacgagtctagtacttattagtcgactacgttactagtacgggaactaacggctaacggtccgtaacggttccgttccggtaccgttaccgggttaaccggggtaacgggttaccgggtaacccggtaacgggttacccgtaacccgggttccgttaacccgggtacccgtaaccgggaccccgaaaccgggtaaccccctaaccccggttaccgttaccggttaaccccg

SEQ ID NO: 149718 - DNA, 779 bp, Homo sapiens
  misc_feature: GYAE6OF02FX8VF.24.81.H04.1.454.CMB.1.raw
  modified_base (217)..(217): a, c, t, g, unknown or other
  misc_feature (217)..(217): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctctgacnctgacaaccatcgagtcgaccttgattgtttaataggtttcgtctcgtgtatcaacaacaccaggacaaacgccccaatcatntattangatgtacaagtacgtccgtcctcgacgggtcttgtagactcgtcctttctcgtcggtccttccgtacggttcgtaggaccaaccggtacccggtccccttacccgtaccgtaaccccgtacgttcccgttccggtccggggtacccctaccggtacgggttccggtaaacggggtaacggggtaacccggtacgggtaccgttacgttaaccgtttaagtttacgttgtaccgttacgtttacgtaacggttacggaaaccgacggtaccgaaggtaccgttacgttcccggtttccggtaaccgtttaccggggttaacgggtaccgggtaaccgggtaacccggtttaaacggggtccccgttaaaccccggggtttcccggttaccgggttaacccgaaacccgggttaaccccggtaaaccccgggtacccccgttaaacccccggttacggttccccggttaacccgg

SEQ ID NO: 149719 - DNA, 679 bp, Homo sapiens
  misc_feature: GYAE6OF02HNJJD.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctctcactcagggcacagggtcctgggcccagtctcgcctgactcaacctgcctccgtgtctgggtctcctggacagtcgatcaccatctctgcactgacaacatcgagtcgacttgattgttattagttgtctcgtgtactacaacaacaccgacggacaaccgaccccaactcatatattatcgtagttcgtactagtaacgtccggtcccgtacggtacgggtcttcgtagtactcgtcttacctcgtacgtcctaccgtacgtcgtacggaccaaccgtaccgtacccgtcccgtacggaaccctacgtccgtcggtacggtccctaccgacggtaccggtggaacgggtcggtaacggtcgtacgttacgttacttacgttacgacgttacgtagtacgtacggtaacgtacgacgtaacgcgtaccgttccggtccgttccggttacgtcggtaacgggtcccggtaacgtaacccggtaccgtacccggttaccggtaccgacgtacccggacccgtaacccggtaccccctaaacccgtccgtacgtacccg

SEQ ID NO: 149720 - DNA, 930 bp, Homo sapiens
  misc_feature: GYAE6OF02HNIR0.24.81.H04.1.454.CMB.1.raw
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccagtcagtcgaccttgatgttatagtttgtctccgtgtatacaacaacaccgacgacaaaccgccccaaatcatagtacttatagtatcgtactaagttaactcccggtaccgtacggtacgggtccttacgttagaccgttcgtacctttccgtccgttacggcccgttaccggttaacgggtttacctaccggggtaacccgtaaaaccccgtaccccggggttacccccttaccccgttaaccggtaaccccgttacctttacccggttccgggtttacccggggacccccttaccccgggtaagggttacccgtaaagggggtaaacccggggtaaccgggtaaccggggtacccgttaacggttaaccgtttttaaacgtttaacggtttccgggtaaacccgtttaggttttaaccgtaaacgggttaccgggaaaccgtaaaccggtacccgggaaacgttaccccgggtaaccggttccccggtttaccggttaacccgttttaaccggggttaacccgggggttaacgggttaaaccccgggggtaacccggtttaaacccgggttccccgggttaaacccccgggtttcccgggtttaaccccgggaacccggttaacccgggggtaacccccccggtaaacccgggtaaccccccccgtttaaaacccggttcccggtttacccggttaacccccg

SEQ ID NO: 149721 - DNA, 577 bp, Homo sapiens
  misc_feature: GYAE6OF02JA466.24.81.H04.1.454.CMB.1.raw
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatctcctgcactgcaaccatcagtcgaccttgattgtttaataagtttgtctctggtatacaacaaccaccagacaaacgacccccaaactcatgtatttatgatgtacagtaatccggcctcggagggtcttcgtagactcgtcttctcgtcgtctccgaggtcnggacacgcgtccctccncgactctcgcgtcggctcgagngaggacggagcgctagtacttattagtcgntactnaagtcgaactagacaggtctacgtctccggtcttacggtacgggacgtacgggaacctaacgggtcccgtacgttcccgacgtccgaaccggtaccggaacccggcccctaaacccgtgtcccgtaacc

SEQ ID NO: 149722 - DNA, 585 bp, Homo sapiens
  misc_feature: GYAE6OF02FMCRH.24.81.H04.1.454.CMB.1.raw
  modified_base (223)..(223): a, c, t, g, unknown or other
  misc_feature (223)..(223): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
tcagactactatgtcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcacatctcctgcactgcaaccntcagtcgaccttgattgtttatagtttcgtctcctgtatcaacaaccaccgagacaaacgcccccaaactcatgatttangatgtacagtaactccgcctgagggcttgtgatcgtcttcgtctgctcgagtcgngacacnccgcctccgngaccatcgcgtcggcctcgagcgtgacggacgaggctgtaacttattagttnactcgtacagtgaacgagacagtacgtacgtccgttacgtcgttacggttacgggtaacgtcggtaaccgtaacgggtacccgttacccggttcccgtaccggttaccgacccggtacccggaaccggtaccccgtaacccgtacgttccgtaaccccg

SEQ ID NO: 149723 - DNA, 670 bp, Homo sapiens
  misc_feature: GYAE6OF02JHPSN.24.81.H04.1.454.CMB.1.raw
  modified_base (364)..(364): a, c, t, g, unknown or other
  misc_feature (364)..(364): n is a, c, g, or t
tcagactactatgtcacgaccggtgctcgatttagtagtgtagattcgcgggggggggtcgtcgaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactgacaaccatcagtgaccttgatgttatagttcgtctctgtatacaacacaccaggacaaaccgaccccaaactacgactcgtattatacgatcgtacagtaacgtccgtccgtacgtacggggtcttacgtgaatccgactttcncgtcgtcctacgtagttccgtggaacctaacgcccggtcctacccgtcaacccgtctccgttacggtcggtctaccgtacggccgttaaggacggaacgtcgggacttacggtaacctttaagtttacttacggtacgttcggttaacgtacgtaacgggtacaacggtcgtaaacggccgtaaacggttccgttaccggtacgtttccggtaagggtaccggtacgggtaacccgtcgtaaaccgtcccgtacgtacgggttacaacccggttaccgacccggacccaacccgtactccgtaccg

SEQ ID NO: 149724 - DNA, 833 bp, Homo sapiens
  misc_feature: GYAE6OF02F8YHE.24.81.H04.1.454.CMB.1.raw
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgacctcaacctgccttccgtgtcgtgggtcctccgtggacagtcgatcaccatcctctgcactgccaaccntcagtctaccttgattgtttaatagtttctctcgtgtatcaacaaccaccaggacaaaccgacccccaaactnactagtatttangactgtacaactaacgtccgtcccgtacggacggggtctttcgacgtacgtccgtctttacctccggtcggtccttaccggtacggttcgtacggacaaccgtaccccggtcccctaccgtacgtaaccgtacgttcccgttacggtccgggtccgttaccccggtaacgggtcgtaacgggtaaccgggtaaccgggtaccgggtcgttaagttaaaccgtttagttttaacgtaccgtaacggtttaccgttaacggtaacgttacgggaaccgaacgttaccgggaacgtaaccgttcccgggttacccgggtttacccggtttacccgttaacgggttttaacccgggggtaacgggttaacccgggggaacccgttaaaccccgggtttacccggtaaaccccggggttttccccggttaaaccgggggtttaacccccaaccgggttaaccccccggaaacccggttacccccccgaaacccccggttacccggttaccgttaaccccccg

SEQ ID NO: 149725 - DNA, 803 bp, Homo sapiens
  misc_feature: GYAE6OF02JA3VA.24.81.H04.1.454.CMB.1.raw
tcagactactatgtcacgaccggtgctcgatttagtagtgtagattcgcggggggggggtcgtcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatctcctgcactcgacaaccatcgtagtcgtacctagtagtttattaagttagtttcgtccgttccgttaggtacctaacaaaccaaacccgaacccgtacggaaacccgaaacccgtaccccccaaacgtactaacttagttaagttagtagtagtacgttactaaccggtaacgttcccggtaccccgtacggtaccgggttcgttccggtacgtaggtcccgttctttacccgtcgttaccggttcccttaccggtacgggttccgtcgtacccgaaacctaccggaccgtcccccgttccgtaccgtaccttaccgtttcctccgggttaccgcccgtccgggttaacgtggtaaaccgggacgggacggccgttacgttacgtaaccttttacggtttaactccgggttaattcggtaacggttacgttaacggaacgtaacggtaccgaagtttaccgccgggtttaacccgttcccgggtacgtttaccgtcggggtaaagggtccggtaacccggtaccgtttaccggtcccgttacggtaccgtcgaaccggccccgtaaggaccccgtaccctacggttacccg

SEQ ID NO: 149726 - DNA, 698 bp, Homo sapiens
  misc_feature: GYAE6OF02G8DDQ.24.81.H04.1.454.CMB.1.raw
  modified_base (294)..(294): a, c, t, g, unknown or other
  misc_feature (294)..(294): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgacaaccatcagtcgaccttgattgtttaataagtttgtctctggtatcaacaacaccaggacaaacgaccccaancatgtatttatgactgtactagtaacgtccggtaccctcggacggggtcctttgtacgtacgtccgtcctttaccgtcgtcggtcctaccgtacggttcgtacggtacctaaccgacccggtacccttcccgtacgtaccgtacgttccgtacggtcggtacctaccggacggtcgtaggaacggtacggcgtacgtagtaactttaagtttacttacgacgttacgttccgaagttacggaactaaggtccgaacggtcgtacgttcccggttaccgtacgtttaccgggttaccgggtaagggttacgggaacccggtaaccggtacccgttaaccggttccgtaccgggttaccgacccggtacccgacccggtaacccctaacccgtagtcccgttaccc

SEQ ID NO: 149727 - DNA, 682 bp, Homo sapiens
  misc_feature: GYAE6OF02GUGGF.24.81.H04.1.454.CMB.1.raw
  modified_base (233)..(233): a, c, t, g, unknown or other
  misc_feature (233)..(233): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctcgtgtcgtgggtctccgtggacagtcgatccactagtctcctgcactgaccaaacctntcagtcgtaccttgtattagtttattaagtttcgtcttccgtggtaactacaaacctaacacccgaaggaccaaaaccgacccccctaaaatcgaacttagtactttaagtagtactcgtacgtaacgtaccgtccggtcccgtaggacgggttcttacgtagtcttcgtcttacgtcgtcgaccttcgtagttcgaggaccaacggtcccgtaccctccgactactactccgtgtccggctcgtagtcgtacggaacggcgtacgctagtaacgttagttgtacgacttacgttacgagtaacggaacacgtacgaacggtctaacggttccctacggtccgttacgtaggtaccgtacgggtaacctaacgggtccaacccggttccggaccggtaacacccggtaacccgtaccggaacccccgtaacgttcccgacgttaccccg

SEQ ID NO: 149728 - DNA, 764 bp, Homo sapiens
  misc_feature: GYAE6OF02IAEG5.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctctcactcaggcacagggtcctgggcccagtctcgccctgactacaacctcgcctcgtgtcgtgggtcctcctggacagtcgatcaccatcctcctgacctactcgaccaaccgatcgagtctaaccttgattagtttaataagtttcgtccttccgttggtactaccaacctaaaccacccgaacggtaccaaaaccgacccccctaaaactacaatacgtaatttatagtatcgtactaagtaacgtccggcctcggagggtcttacgtcgtacgtccgtcttcctcgttacggcctacgtaggttcgtacgacctaaaccgccggtcccctacccgtacgtaaccctacttccgtacgtcgggtacctaccggtacgggtcgtagggacgggtaaccggtacgggtacttacggttaacctttaagttacgttcgacgttacgtttacgtaaggttaccggaaagaaccggtacgaaccggtcgttaccgtacccggttaccggtccgttaccggttaacgggaaccggttacgggtaacccgtacgggttacccgtaacccgggttaccgttacccggtaccacccgggttaaccccgaaacccgggtacccccaaaccccgttccgtacgttaccccg

SEQ ID NO: 149729 - DNA, 801 bp, Homo sapiens
  misc_feature: GYAE6OF02H9UIB.24.81.H04.1.454.CMB.1.raw
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactcgccaaccatcagtcgaccttgattgtttattaagtttcgtctccgtaggtactacaacaaccaccagacaaaccgccccaaactcatcgtaatttactagtatgtanagtaactcggcctgacgggtcttcgtnactcgtcttcctcgtgtccgtacgtacggtcgtacggtaccgaacgtacccggtccctcccgtacgtaaccctacgttcccgtccggtttacgggaccctttaccggacgggtccgttaacgggggacgggaaaccgggttggtacccggtttacgtaaccgttttaagttttaacgtccgggttacgttaacggttttaccgaacgggtttaaccgggaaaaccgtaacgtaccgggtacggtaccgtttaacccgggttacccggtttaccccgggtaccgttttaccgggtaacggggtaaccgggtacccggggtaaaacccggtaccgggttaaccccgtacccgggttaccccggttacccgggtaacccggtacccggtaaacccccgggtaacccggtaacccccctaaaaccccgttccggttacgttaaccccccg

SEQ ID NO: 149730 - DNA, 621 bp, Homo sapiens
  misc_feature: GYAE6OF02G1MQ2.24.81.H04.1.454.CMB.1.raw
  modified_base (256)..(256): a, c, t, g, unknown or other
  misc_feature (256)..(256): n is a, c, g, or t
  modified_base (299)..(300): a, c, t, g, unknown or other
  misc_feature (299)..(300): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (419)..(419): a, c, t, g, unknown or other
  misc_feature (419)..(419): n is a, c, g, or t
  modified_base (607)..(607): a, c, t, g, unknown or other
  misc_feature (607)..(607): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgttatagttgtctcngtatacaacaacaccaggcaaacgccccaaactcatgatttannatgtcagttactcggcctgacgggtcttcngtatctcttcncgtggcctcgagtctgaccaacgcgccctccgtacacctagtctcgtcgggtcctaccgaggtctaggacggtacggnggtcctagtaacttagtttacgtgacgttacgtacacgttaggaaactacgaccgaacgctaacgtccgttccggacgttaccggttacgggtaaggtccgggtaaaccggtaaccggttacccgtaacccgggttcctaaccgggtacccaaccgggtaccccgaaaccggtacccccgaaaccccnggtttaccaccccg

SEQ ID NO: 149731 - DNA, 606 bp, Homo sapiens
  misc_feature: GYAE6OF02JKML1.24.81.H04.1.454.CMB.1.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
tcagactactatgtcacgaccggtgctcgatttagtagtgtagattcgcgggggggggtctcaggaggcagcgctctcgggacgtctccaccatggcctgggctctgctattcctcacccctcctcactcagggcacagggtcctgggcccagtctgccctgactcaacctgcctccgtgtctgggtctcctggacagtcgatcaccatcctcctgcactgcaaccntcagtcaccttgattgtttattagttgtctcgtgtatcaacaacaccagacaacaccccaactcatntattatagtatgtacaagtaacgtccgtacccgtacggtagggtcttacgtagactcgtcttctcgtcgtacctcgaggtcgtacggaccaacgtaccgcctacccgtacgacctatccgtcgtcggtcctacgacggtcgtagaacgggtaccgacggtcgtagtacttaagttcgttcgacttagtacgtagtacgacgtaagcgagacgtacgtccgttcgtacttacgtacggagtacgggacgtacggtaacgtacggtccgtaccgtacgaccgacccgtaaccgccctaacccgtagtccgtaac

SEQ ID NO: 149732 - DNA, 556 bp, Homo sapiens
  misc_feature: GYAE6OF02G14Y8.24.81.H04.1.454.CMB.1.raw
  modified_base (377)..(377): a, c, t, g, unknown or other
  misc_feature (377)..(377): n is a, c, g, or t
tcagactactatgtcacgaccggtgctcgatttagtagtgtagattcgcggggggggggtctcaggaggcagcgctctcgggacgtctccaccatggccctgggctctgctattcctcacccctcctcactcagggcacagggtcctgggccccagtctgcccctgactcaacctgcctccgtgtctgggtctcctggacagtcgatcaccatctcctgcactgcaaccatcagtgaccttgatgtttataagtttgtctcctggtatcaacaacacccaggcaaaacgcccccaaaactcatgatttatgatgtcaagtaatcgccctcgagggcttctgatcgcttctctggctcgagtctgacacgcgcctccncgaccatctcgtgggctccgaggtctggaggacgaggctgaacttattaagtgtacattcaagtggaacagcagcagttccgtcggtacttacgtacgggacgttacgggaacctaagggtcccaccggttcgtccggtacaccggaccccggtaagacccccaaccctgtccgtaccg

SEQ ID NO: 149733 - DNA, 631 bp, Homo sapiens
  misc_feature: GYAE6OF02GHFCU.24.81.H04.1.454.CMB.1.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
tcagactactatgtcacgaccggtgctcgatttagtagtgtagattcgcgggggggggtctcaggaggcagcgctctcgggacgtctccaccatggcctggggctctgctattcctcaccctcctcgactcagggcacagggtcctgggcccagtctgccctgactcaacctgcctccgtgtctgggtctccgtggacagtcgatcacntctctgcactgccaaccatcagtcgaccttgattgtttatagtttcgtctctggtatacaacaaccaccagaccaaccgaccccaaactcatcgtatttanagatgtcaagtacgtccggcctaggacgggtcttcgtagagtccgtcttcgtcgtcggtcctcgtggttcgtcgacgacgtaccggtccctaccgtacgacctactcgtccgtcgggcctaccggagtcgnggacggacggacgtcgtacgtacttattcgtacgtacgtacgtacgacgtacggaacaagtcgacgacgtaccgtccgtcgtcgtaccggttacggacggtaacgggtacggaacggttccgtaccggtccgtaccggtccgaaccggtccccgaaccggtaacccctaacccgtacgttaccggtaccc

SEQ ID NO: 149734 - DNA, 775 bp, Homo sapiens
  misc_feature: GYAE6OF02I2OEG.24.81.H04.1.454.CMB.1.raw
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagactactatgtcacgaccggtgctcgatttagtagtgtagattcgcggggggggggtctcaggaggcagcgctctcgggacgtctcaccatggcctgggctctgctattctcaccctctcactcagggcacagggtcctggcccagtctgcctgactcaacctgcctcgtgtctgggtctcctggactagtcgactcgaccatctcctgccactgacctaaacctactcacgtcgtaccgttgaattagttttataaacgtttcgtactcttggttactcaaacaaccgaccgaggaccctaaaccacccccaaacttaccacgttagtacgtttaactggtaatcggtacaacgttaacgcggtacccttaggacggggtctttcgtacggntccgtnttacncgtttcggaccttacgcgttacgtcggacctaacgtcccggaccttacccggtacgtaacctaacgttcgtaccgtacgggtacccgtaccggttaacgggtccgttacggggaacggaaccgggtagggttacctaaaccggtttaacttacctttaacgttccggtaccgttaacgtttacgaaacgtacggtaaaccggtaacgtaacgtacggttaaccgaacgttccggtttacccgaaccgtttaccgggttaaccggttacgggaaccgggaacccgtaaaccggttaccgtaaaccggtcccgttacgggtacctaccggtaaccacgggttaaccccgaaccgtaaccttcgtaacccc

SEQ ID NO: 149735 - DNA, 886 bp, Homo sapiens
  misc_feature: GYAE6OF02JRLNO.24.81.H04.1.454.CMB.1.raw
  modified_base (136)..(136): a, c, t, g, unknown or other
  misc_feature (136)..(136): n is a, c, g, or t
  modified_base (151)..(151): a, c, t, g, unknown or other
  misc_feature (151)..(151): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagactactatgtcacgaccggtgctcgatttagtagtgtagattcgcgggggggtcgtcaggaggcagcgctctcgggacgtctccaccatggcctgggctctgctattcctcacctcctcactcgagggcacngggtcctgggacccngtctgccctgactcaacctgcctccgtgtctgggtctccgtaggcagtcgatcgacntcnccgtgcactcgcaaccgtatcagtcaccgtttgacttggtttatacgttttgtacttcctaggtactacctaacgaaccacccgaggaccaaaaccggacccccctaaaactcgtaacctacgtaattttacgtacgtaacgttcgtacgtaaacggtttaaccgtacccgggttccccgttacggtaacggggttccttttccggttaccggttaaattaccggtttccgtttacccggtttccggttaacggttccccgtaaccggtttaacggtttccggttaacggggaacccctaaacccggtaccccgggttcccgttaccccgtacgggaacccctaacgggtttcccgtaaccggtcccggggtacctttcccgggaaacccggtcggttacggtaaccgggggaaccggtacgttaccggttacgttaacgggttttaaacttttaggtaccgttaaccggtttgtacccgggttaaacgttacggggtaaacctttaacgggaacgaacgggttacccgtaacgtttacccgggttcccggttccgttaacgttacccggggtaacggtttaccgggaaccgttaaccggttcccgtaaaccggtccgtaccggtaccgtaccggcccgtaaaccgaccccgttaaacccgccgtacgttacccg

SEQ ID NO: 149736 - DNA, 737 bp, Homo sapiens
  misc_feature: GYAE6OF02H8122.24.81.H04.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatctcctgcatgccaaccntcaagtcgtaccttgtattgtttaattaagttttcgtcttccgtggttactcaaacaaccaccaggacaaaaccgacccccaaactcatgtaacttttangtatgtactagtaactccgccttcggacgggtcttcgngtactcgtcttccgtcgtcgcctccgtaggttcgtcggacctaaccgccggtaccccttccgtacgaaccttactccgtacggttccggcctacgacggtcgtaagggacgggacggacggtacgttacgtaacgttttaagtttcgtagttaccgtacgtttaacgacggtttaacggaacgtaccgtaaccgacggttaccggaccgtttacccgggttccgttaccggtttaccgggttaacggggtaaccgggtccggggtaaacccgttaacggggtaccccttacgggtccccggttaccggtaccccgtaacccgtaccccggtaaccccggaccccccttaacccgtccgtaccgtttaccccg

SEQ ID NO: 149737 - DNA, 640 bp, Homo sapiens
  misc_feature: GYAE6OF02F99XK.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgacctcaacctgcctccgtgtctgggtctcctggacagtcgatcacatctcctgcactgccaaccatcagtcgaccttgattagtttataagtttgtcttcctgtactacaacaaccaccgagaccaaaccgacccccaactcatagtactttaagtgtatacgtacaagtacgtccgcccgtggacgggtcttcgtgtactcgtcttcgtcgtcggcctacgcggtcgtacgaccacgaccgtccctaccgaccacctcttcgtccggtacggcctcggaggtcgtacggacggacggagtcctaggttactttagtttacgcgtacgttgttacgagttaggaaccagtaccagcctacggtccgttcggtctacgggttacggtacggacggtaaccgttaaccggccgtacccggttccgtacggaccgtaaccggacccgtaacccggccctaaccccctagtacccgtacccg

SEQ ID NO: 149738 - DNA, 716 bp, Homo sapiens
  misc_feature: GYAE6OF02HDJIH.24.81.H04.1.454.CMB.1.raw
  modified_base (375)..(375): a, c, t, g, unknown or other
  misc_feature (375)..(375): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgaccaaccatcagtcgtacccttgacttagtttaataagtttgtcttccgtggtatacaaaccaacaacccgaaggacaaaccgccccccaaaactacactagtaatttagtagtagtgtactaagtaacgtccggtccctacggacgggtcttcgngtactcgtcttcctcgtcggtcctccgtacgtcgtacggaaccaccgacccggtccctccctacgacctacttcctccggtccggacctccggtagggtccgtagggaaacggggtaccggaacggtccttacgggttaactttaagtttaacgttcgtaccggttatttacggaacgttaccggaaacgtaacgccaggtaaccgtacgttaccggttcccggtaccgtttacggttaacgggtacggttaccggaaccgtacgggtacccaccggttaccgttaccggaccgacgtaccccggaaccgtcccggtaaacccccgtgtaccgtaaccccg

SEQ ID NO: 149739 - DNA, 714 bp, Homo sapiens
  misc_feature: GYAE6OF02GDQ0T.24.81.H04.1.454.CMB.1.raw
  modified_base (306)..(306): a, c, t, g, unknown or other
  misc_feature (306)..(306): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtcctcctggacagtcgatcaccatctctgcactgaccaaccatcagtcgaccttgattgtttatagttgtctctggtatacaacaacaccaggtacaaacgccccaactcatgtactttangatgtacagtaacgtccgccctcgacgggtccttgtagtacttaccggtcttccgtcgtcggtaccttccgtaacgggttcgtacgggacctaacccgtacccggtcccgttacccgtaccggtaccacgttccgtccggtcgggaccttaccggaggtccgtacggacggtacgggtacgacgttacggttaacttagtttacgtacgtacgtacgttacgacgttacggaacgtaacggacgttaacgccggttacgtacccgttcggtaccgtttcgggttacgggtaacggtcccgggtaaaccgaacggtaccccggtacccgggttacccgtaccgggttacccgaaccggaccccggttaaacccgacccctaaccccggttacctaccggttaaccccgg

SEQ ID NO: 149740 - DNA, 703 bp, Homo sapiens
  misc_feature: GYAE6OF02IC97V.24.81.H04.1.454.CMB.1.raw
  modified_base (223)..(223): a, c, t, g, unknown or other
  misc_feature (223)..(223): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcactgcctcgtgtctgggtctcctggacagtcgatcaccatctcctgcactgacaaccntcatgaccttgattagttatagtttgtctcttggtatacaacacaccaggaccaaacgccccaactacatgtatttatagatgtactagtaagtccgacctacgtaggggtcctttcgtgtacgtccgtcttccgttacgtcggccgttcgtacgggttcgtcggaccgaacgacccggtccctacccgttcgaacccttacgttaccgtccggttcggggtaccctttccggaacgggtcgtaacggacgggtaacggtacggtacttacggttaactttacgtttacgtcgtacgtcgttacgacgttacgggacgtaacgtacgacgtacgtacgttaccgtcgggtaccttacgggttacggaacggtaccgggtaccgaaccggttacccgtacccgggtacccgttaccggtaccgtaccggaaccccggtaacccggtaacccctaaccccgttacccgttacggttaccccg

SEQ ID NO: 149741 - DNA, 807 bp, Homo sapiens
  misc_feature: GYAE6OF02JJN6O.24.81.H04.1.454.CMB.1.raw
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctcgggcccagtctgccctgactcaacctgcctccgtgtctgggtctcctggacagtcgatcaccatctcctgccactgccaaccatcagtcgtaccttgattaggtttaataagtttgtctcctggtactacaacaacaccaggacaaacgcccccaaacncatagtatttangtattcgatagtaactcggcccgtacgtaggggtccttcgtacgtacgtccgtccttcgttaccgtcggtacccgttaccgcgggttaccgtacgtaaccgtaacccggaacccggttcccctaccccgttacgaaccctactttaccgttaccgtccgggtcctacccggtacggtacgtacgggaacgggtacggtacgggtacctaacggttaaccgtttaaatttaccgttacgaccgtttaccgttaccggaacgttaacgggaacccgttaaacggacggttaacggacccggtaaccggtttcccgtttaaacccgggttaccgttacccggttttaacggggtaacccgggtttacggggaacccggttaaacccgggttaccggttaccccgggttacccgttacccggggttaaccgacccggggtaaccccgaacccggtaaccccccgtaacccccgtaccggttacccgttaacccg

SEQ ID NO: 149742 - DNA, 697 bp, Homo sapiens
  misc_feature: GYAE6OF02II2LF.24.81.H04.1.454.CMB.1.raw
  modified_base (549)..(549): a, c, t, g, unknown or other
  misc_feature (549)..(549): n is a, c, g, or t
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctcgccctgactcaacctgcctccgtcgtctgggtctcctggacagtcgatcaccatctcctgcactgaccaaaccatcagtcgaccttgattagtttaattaaggtttcgttccttccgttggtactacaaccaaccacccgaggacaaaccgaccccaaactctaatagtatttactgtattcgtactaagtaacgtcccggcccgtacggcgggtaccttcgtcggtacgtccgtctttctcgtcggtccgtaccgtggtcggtcggaccaacgacccggtccctccctacgacctacgtccgttcggtcggtcccgtcggtacggtcgtaagggacggtacggacggtgtacggttaactttagtttattcgtactagtacgagtacgaanacgacgacgcgtacgtccgtccggtacgttaccggtacgggtacggtaccgggtaaccgtaacgggtacccgtccggtttacccgtccggtaacccgacccgggtacccgaacccggaaccccctaacccgtaccgttaccgtacccg

SEQ ID NO: 149743 - DNA, 735 bp, Homo sapiens
  misc_feature: GYAE6OF02I3HM2.24.81.H04.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagactactatgtcacgaccggtgctcgatttagtagtgtagattcgcggggggggtctcaggaggcagcgctctcgggacgtctccgaccatggcctgggctctgctattcctcaccctcctcactcgacgggcacagggtcctgggcccagtctcgccctgactcaacctgcctccgtgtctgggtctccgtggacagtcgatcacatctcctacactnccaacntcagtcaccttgacttggtttatagtttcgtccttctagtactcgaactaaccaccacggtaccaacgaccccctaaacnctaatcggtatttancgtatcgtacacgtaactccggacctacggtcgggtcttcgtgtacgtcgtcctacgtcgtacgtccgtaccgtagggtcccgtaacggcgtaacccgtaccgggtccccgtacccgtacgtacccgtacgttccgaaccgggtccggtacgtaccggtaacggtccgttacggaaccggtacggaccggttactacggttaccgtttaaacgtttacgttaccgccggttaacgtttacggacgtttaaccgggaacgtaccgtaacgacggtccctaccgttacccgttccggtaccttcgggttaacggtacgtaccggtaaccggtaccgtaccgtacccgttaccgtaccggaccgaccggttaccgaccgtccgtaaccccggtcccgttacggtaccttacccgg

SEQ ID NO: 149744 - DNA, 657 bp, Homo sapiens
  misc_feature: GYAE6OF02FMNNB.24.81.H04.1.454.CMB.1.raw
  modified_base (524)..(524): a, c, t, g, unknown or other
  misc_feature (524)..(524): n is a, c, g, or t
  modified_base (641)..(641): a, c, t, g, unknown or other
  misc_feature (641)..(641): n is a, c, g, or t
  modified_base (650)..(650): a, c, t, g, unknown or other
  misc_feature (650)..(650): n is a, c, g, or t
tcagactactatgtcacgaccggtgctcgatttagtagtgtagattcgcggggggggggtctcaggaggcagcgctctcgggacgtctccaccatggcctgggctctgctattcctcaccctctcactcagggcacagggtcctgggcccagtctgcccctgactcaacctgcctccgtgtctgggtctccgtggacagtcgatccacatcctcctgcactgacaaccatcagtctaccttgacttagtttaattacggttttgtcctcgtaggtactacaaacaaccacccgagaccaaaccgaccccctaatacatacgtatttatagtattacgtacaacgttacgtccggtcccgtacgtacggggtcttcgtagtacgttccgtcttcctcgtcggtcctaccgtcggtcgtacgaccgaaccgcccgtcccttcccacgtaccctattcccgtcgtcgggtacctccggacggtcgtacgggaacggacggtacggtacgtacgtacgttattacgtntacgttagtacgtagtaggaaccagcgaccgtagtccgtccgttcgtcgtcgtaacggcggtaccgacggtacggacctaccggtcctcggaccgtaccggacccgaaccgtacccncccgtacgnttacccg

SEQ ID NO: 149745 - DNA, 625 bp, Homo sapiens
  misc_feature: GYAE6OF02GKHDP.24.81.H04.1.454.CMB.1.raw
  modified_base (341)..(341): a, c, t, g, unknown or other
  misc_feature (341)..(341): n is a, c, g, or t
  modified_base (489)..(489): a, c, t, g, unknown or other
  misc_feature (489)..(489): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggctcctggactagtcgatcaccatctcctgcactgccaaccatcagtcgaccttgaagttgtttataaggtttgtacctcgtcggtatcaacaaccacccaggacaacgcccccaaaactcatagatttactgatgtcaaggtatcggcccgtacgnggggtcttctgctaccgtcttactcgtcggtctaccgaggttcgtcggtacaacgtacggtccctaccgtccgaccgtatccgtcgtcggtccgtaccgcggtctagggacggagaccggctacgtacttagttacttgtcgtagtanacgtagacacgctagaccgtagtccgtcggtcttccgttacggaggtaccggacggtaacggtacccgcccgttcccggtaccgtccgacggacccggtaacccgaccccgtaacccgtactaccgttaaccccgg

SEQ ID NO: 149746 - DNA, 605 bp, Homo sapiens
  misc_feature: GYAE6OF02IG2JB.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttaataagttgtctcctggtatcaacaacacccaggcaaagacccccaaactcaatgtattttaatgataggtacagtaatccggccctcgaggggcttctgactcgtcttactctgggtctcgtaggtctggacaacacggccctcccgtcgaccaacgtctccgtgggcctccgacggtactgaacggacgaagggctacgaactttagttaagttgactagttcaagttggaacaagccgagaccgagtccgttaccggcttaccgtcgggaaggtcgggaacccgaacggtcctaacccggtcccgtccggtaccgacgaccccgaaaggccccctaaaccccgtacgtcgtaacccg

SEQ ID NO: 149747 - DNA, 819 bp, Homo sapiens
  misc_feature: GYAE6OF02FKHJ4.24.81.H04.1.454.CMB.1.raw
  modified_base (345)..(345): a, c, t, g, unknown or other
  misc_feature (345)..(345): n is a, c, g, or t
  modified_base (797)..(797): a, c, t, g, unknown or other
  misc_feature (797)..(797): n is a, c, g, or t
tcagactactatgtcacgaccggtgctcgatttagtagtgtagattcgcggggggggggtcttcgagggaggcagcgctctcgggacgtctccaccatggcctgggctctgctattcctcaccctcctcactcagggcacagggtcctgggcccagtctgtccctgactcaacctgcctccgtgtcgtgggtctccgtggactagtcgatcaccatctcctgccacgtcgccaaccatcgagtcgtaccttgtattagtttattaagttttgtcctcgtggtactaccgaaaccaaccgacccggaggaacccaacccgacccctaactcagtacgttagttagngtagttcgtaacgtacgttaccgtccggtaccgtacggtacgggttactttcgtacgtacggttcctaccgttttcgtaccgttccggttacccgttaaccgggtacggtttccggaaccgggaaaccgtaaccccgtaccccggggttccccttaccggtaacccttccgtacttcccggttacgggtcgtacccgtaccggaaggtaccggtagggaaccggtacgggtaccgtacgttaacgttaaacgtttaagtttaccgtaccgtaacgttacgtaacgacggtaaacggtaccgaacgtacgtaacggttccggtaaccgtttcccggtaccggtttacgtaccggggttaacggttaccggggtaccggtaaccgggtcccggttaacccggtacccggttacggttccggacccgaccggttaccccgaacccggtaaccccnccggtaccgttccgtaacccgg

SEQ ID NO: 149748 - DNA, 764 bp, Homo sapiens
  misc_feature: GYAE6OF02JO7IL.24.81.H04.1.454.CMB.1.raw
  modified_base (607)..(607): a, c, t, g, unknown or other
  misc_feature (607)..(607): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgccactgcctaaccattcgacgttcgtaacctttgtatttagttttaacttaaggttttcgttaccgttccgttagggttactaactaaaccgtaaaccaaccccggaacggacccgaaaaccgtacccccccaaacttacccgtaagtcgttaaatttaccgtagtacgttacgtaccgtaaacggtaaacgtcccgggtacccgttccggtaacggggtacctttaccgtacggtacttccgtcgtttcgttaccgttcggtccgtacccgtagggtccgtacggtactaaccgtacccggtccctacccgtcgtaaccgtcgtaccgtcgtacggtcctccggtaggccgtacgggacggtacggtacgcttcgtactttacgttgtacgngttactcgatacgggtacacgtagacgtacgtacgtccgttacgtcgtacgttacggtacggttaacggaccggtaacggtccgttaccggtaccgttacccgggtacgtacccgacccgtaaccggaccccgtaccccgttaggtacccggtaccc

SEQ ID NO: 149749 - DNA, 760 bp, Homo sapiens
  misc_feature: GYAE6OF02H3DAY.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgccactgccaaccatcagtcgaccttgattgtttatagttgtctcctggtactcaacaacacccaggacaaacgcccccaactacatacgtatttatgatgtacagtaactaccggcctcgacggggtccttacgtgtacgtcgtcttcctcgtcggtcctccgacggttcgtacgacaaccgaccggtaccccttcccgtacggaaccctaacgtccgtccggttccggggtccgtacccgtacgggtccgtagggacgggtaacggacgggttacgttacgtaaccgtttaagtttacgttcggtacgtaggttaaccgtaaggttacgggaacctaaaccggccgaacggacctaaccgggttacccgtttacccgggttaccgtttcccgggttttaaccgggaaccggggtttaccggggaaaccggtaaccgggtttaccccggtaccccggttacccggttacccggttacccggaaccgggtacccccggaaacccggtaccccccgtaaacccccgtacgttacccggttaaccccgg

SEQ ID NO: 149750 - DNA, 654 bp, Homo sapiens
  misc_feature: GYAE6OF02IHDDT.24.81.H04.1.454.CMB.1.raw
  modified_base (225)..(225): a, c, t, g, unknown or other
  misc_feature (225)..(225): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcacatctcctgcactgcaaccntcagtcgacttgattgttatagtttgtctctgtactacaacaacaccgagaccaacgacccccaatcatgtactttatagtatcgtcaagtaacgtccggtcctacggagggtcttacgtagtctcgtcttacgtcgtcgtcctaccgtggtctacggaccaaccgtccgccctccgtacgaccgttatccgtcgtcggtcctaccgcggactagggaacggtacggagcgttaacgtaacgtttattacgtagtacgttaacggtactaggtaacggtaaccgaagaccgaaggccgttccgtaccgttccggtacttacggttacggtaacgggtcgggtaaccctaacgggtccctccgtaccggttacccggacgaacccggccgaaacccggttaacccctaaccccgtaccggttctaacccg

SEQ ID NO: 149751 - DNA, 822 bp, Homo sapiens
  misc_feature: GYAE6OF02JPPUD.24.81.H04.1.454.CMB.1.raw
  modified_base (133)..(133): a, c, t, g, unknown or other
  misc_feature (133)..(133): n is a, c, g, or t
  modified_base (229)..(229): a, c, t, g, unknown or other
  misc_feature (229)..(229): n is a, c, g, or t
tcagactactatgtcacgaccggtgctcgatttagtagtgtagattcgcggggggggtcgtcaggaggcagcgctctcgggacgtctccaccatggcctgggctctgctattcctcaccctcctcactcaggnacagggtcctgggcccagtctgccctgactcaacctcgcctccgtgtctggtctcctggacagtcgatcaccattcctcctgccactgaccaaccntcgaagttcgacccttgacttagttttacttaaggtttttgttccttccgttacggttacttaccaaaaccgtaaacccctaccccggaacggaacccgtaaaaaccgaccccccccgtaaaacttacctaacttaacggttaattttaacgttaggtaacttcggttactaaacgttaacggttcccggtacccgttaccggacggggtttccttaccgttggacttcccggtacctttctccggttcgcccgtaccgtcgtacggtacgtaacccgaacccgttcccggtacccttcccggtaccgtaacgttccgttaccgttccgttccgggtacccgtacgggtacggtacgggaacggttacgggaccggtccgtaccgttaagttccgttttagtacgttcgaacgtttagtacctaggtaaccggaagtaccgaacctgtaaccggtcgtttaccccgggtccgttacgtttaccggtaacccggtaggtaacccgtaaccgtcggtaacccgttcccggtcggtaccggtaaccgacccggtacccgaaaccggtacccccgtaaccgtaccgtccttaacccg

SEQ ID NO: 149752 - DNA, 774 bp, Homo sapiens
  misc_feature: GYAE6OF02HHBPC.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtcgtgggtctcctggaccaggtcgatccacatctcctgcactgccaaccatcagtcgaccttgattgttatagtttcgtctcctgtatcaacaacaccaggacaacgcccccaaactcgatacgtaatttacgtagagttcgtacgtagtaacgttcccgggtaccctacggaacgggggttccttcgtacggtaacgttcggtcctttcctcgtcggtccgttaccgacgggttctacgggaacccaaccgtaccgggtaccccttacccgtcgaacccgtacttcccgttacggtaccgggccgttaccggacggtcgttagggaacgggtacgtacgggtccgtaggttaactttaagtacgtttacgacgttacgttacgaaggttacggaaccgtaacgcgaaaccgtcgtaccggtcggtttacccggtcgtttaaccggttaccggggaacggggttacgggtaaaccccggtaacgggtttaacccccggtacccggttcccggttaacccggttaccggacccggtaacccccgggaaaccccggttacccccgtaaacccccggtccgtttacccggttaacccc

SEQ ID NO: 149753 - DNA, 615 bp, Homo sapiens
  misc_feature: GYAE6OF02FTFIH.24.81.H04.1.454.CMB.1.raw
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtcgaccttgattgtttataagtttgtctcctggtatcaacaacaccagacaaacgacccccaaactcatgtatttactgtatgtacaagtaagtcccggcccgtacgaggggtcctttcgtcgacttcgtcttctcgtcggccttaccgacggttcgtcggaccaacgaccggtcccctcccgtacgacctacgttcctacgtcgggtcctccgacggtcgtaggacgggacggtaggccgttaagtacttagttattcgattacgttatacgttggacgaacgcagcgacgtccgtccggtactcgttacggagtaccggaacgtaacggtactacccggtaccgtggtaccgacgtaccgaccgacccacccgtactcgtaccg

SEQ ID NO: 149754 - DNA, 777 bp, Homo sapiens
  misc_feature: GYAE6OF02JNAXD.24.81.H04.1.454.CMB.1.raw
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (539)..(539): a, c, t, g, unknown or other
  misc_feature (539)..(539): n is a, c, g, or t
  modified_base (653)..(653): a, c, t, g, unknown or other
  misc_feature (653)..(653): n is a, c, g, or t
  modified_base (768)..(768): a, c, t, g, unknown or other
  misc_feature (768)..(768): n is a, c, g, or t
tcagactactatgtcacgaccggtgctcgatttagtagtgtagattcgcgggggggggtctcaggaggcagcgctctcgggacgtctccaccatggcctgggctctgctatcctcaccctcctcactcagggcacagggtcctgggcccagtctgccctgactcgacctgcctccgtgtctgggtcctccgtacggacaggttccgattcaaccgntccgttcgacgcactcggaccaacctntccaggtcgtaacccttgtacgttcggttttacttaaacggtttgttacccgtnttcggtaattaccaaaccaaccgttacccaacggggaccaaaaccggtaccccaaacttccgaaatccgtaatttacgcgtaacttggtacctaagttaaccgccggtaaccctgggtaccgggtccttaacgtcgtacggttcttaacgtttcccggttctaccggtccgttaccggtacccgggtgttaccgggaaacctaaccgggcccggccccctttaaaccggtctaaacccgttntaacccgtttcgttcgggaaccccttaccgacggttccgtacgggaaccgtacggagtaccgtttaaggcttttaacgttagttccgaatacgttcaacgtcgaacgacgtaancccgttaagccggttcccgtcgttaccggtctaacccggggtataccggggacctaccggtaacgtcccgttaccgttccggaaccgacgacccggttaacggcccctaaccggntaccgtccg

SEQ ID NO: 149755 - DNA, 832 bp, Homo sapiens
  misc_feature: GYAE6OF02FNKXS.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacagggttcctgggcccagtctgccctgactcaacctgcctccgtgtctgggtctcctggacagtcgatcaccatcctctgcactgctaaccatcagtcgaccttgtacttagttttaataacgttttcgttaccttccgttaggtataccaaacctaacctacccgtaaggacctaaaccgaccccccctaaaacgtcaagttacgttaactttaacgtagtacgttacgttaccgaaggttttaaaccgtcccgggtccccgttaacgggtaccgggggttccctttacgggtaccttaaccggttcccgttccttttccgttaccggtcgggttaccctacccggttaaggttcccggtacgggaccctaaacccggtaccccgggtccccgttaccccgtacgtaaccccgtagtttcccggttaccggtcggggttcctacccgggtaacgggttaccggtacgggtaacggggtaccggtacggttacgttaacggttaacgtttagttacgttacggaacctttagttacgtaacggaaggttaacaaacgttcgacggtacgtaccgttccggttaccggtcctttcgggttaacggttacggaaccgggtaccgtaacggttcccgacccggttaccgtaccggtaaccgccaccggtaacccgaccctacccgttactccggttacc

SEQ ID NO: 149756 - DNA, 827 bp, Homo sapiens
  misc_feature: GYAE6OF02IAKE7.24.81.H04.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (818)..(818): a, c, t, g, unknown or other
  misc_feature (818)..(818): n is a, c, g, or t
tcagactactatgtcacgaccggtgctcgatttagtagtgtagattcgcggggggggggtctcaggaggcagcgctctcgggacgtctccaccagtggcctgggctctgctattcctcaccctcctcactcgagggctacgtagggtcctgggccagtctcgcctgacctacaaccgtgcctccgtgtctgggtctcgtggacngtcgactcacgntctcngctacgtcgacaacgntcgacgttcacgttagtagttagttaacgttagtttcgtccttcgtaggtactctaaaccacctacgacgaccaaccgtacccaactcacgtacgttacgtttagtcggtacgttcgtaacgtaacggtaaccgtcccgggtacccgttaggaccggggttaccttggaccgttaccggttcttaacccgtttcggcccgtttaccggtacccgttaccggtaggtaccggtttaaccgggaacccgtaacccgaccgggtttcccccgtaaccgtcccgtaaaccgtttcgttacccgggttcgggtaacccggttacccgtaccggtaagttcccggtaggaaccggggtacgtacggtacggttaacgtaccgttttagggtaagttccgtaaacgttacggttactaaggggtcgaaaaccgtggtaccgaacggttacccgttccgttcggtccgtttaaaccgtcgggtaaccggttaggggtaaccgtaccggtacgggttaccccgtacgggttcccgtaacgggaacccgtaccggttaacccgggacccgtaaccccgtaccggttacctntacccccgg

SEQ ID NO: 149757 - DNA, 889 bp, Homo sapiens
  misc_feature: GYAE6OF02FQGWK.24.81.H04.1.454.CMB.1.raw
  modified_base (228)..(228): a, c, t, g, unknown or other
  misc_feature (228)..(228): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcaacctgcctccgtgtcgtgggtctcctggacagtcgatcacatcctactgcacgtgacaaccntcgagtcgtaccgttagtacttagttttaattaacggttttcgttaccttccgttacggttaacttacctaaaaccaaacccgtaaccccgaacgggtaacccaaaaaccccggacccccccctaaaaaccttaccaagttacgttaaacgttttaacgtagtaagttcgtaccgttaacggttaacgtaccccggtccccgttacgggtaaccggggttcctttaccgtacgtcgttccgttccgtttaccgttccggttcggtcccttaccggtacgggttcggtaccggaaccgtaaccgtcccggtaccctacccgtaccgaaccgttaccttcccgtttccgtacggggtaccccttacgggccggttacggccgggaaacgggtaccgggtacggtaccgttacgttaaccgtttaatttaccgggtttacgtacggttaacgtttaacgtacggttaccggaaacgaacggaccttacgggaccggttaccgttaccggtttcccggtaccgtttcgggtttaacggggaccgggttacggggtaacccgtaaccgggttacccggtacccggttacccggtaccggtaacccgaaccgggttaccccggaaacccggtacccccggtaaaccctaccgttcccgttaacccgg

SEQ ID NO: 149758 - DNA, 818 bp, Homo sapiens
  misc_feature: GYAE6OF02FVGLM.24.81.H04.1.454.CMB.1.raw
  modified_base (129)..(129): a, c, t, g, unknown or other
  misc_feature (129)..(129): n is a, c, g, or t
  modified_base (134)..(134): a, c, t, g, unknown or other
  misc_feature (134)..(134): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactnagggntacaggtcctcgggcccagtctaggcccgtgactacgaacgtgcctccgtgtctgggtctcctggacngtcgatcaccgtntctccngctctgcaactgtcagtcgtaccttagattagttaataacggtttcgtaccgttctcggtataccgaaacgttaaccgaacccgttaggacccctaaacgtaccccccgtaaacttccgtagttacgttaacgttacgtcgtaagttccgtacgtaacgttaacgcccgtaccgtaggtacgggtacttacggtacgtacttccggtactttcccgtacgtaccgttaccgtaccggtacggttacggtacggtaccaacccgttacggtacccgttacgtaccgaaccttacgtccggttacgtccgggtaccgttaacggccgttcggtaaccggtacggtaaacccggtcggtaaaccggtttctaacgttacgtttcggtaccgtagtccgtaaccggtagtaccgtacgtaaccgtgtacctaccggtacgttaccggttacgtaccggttaaccgtacggggttaacccgtagggttaacccgtaacggttaccccggggttacccttaccggttaaccccgttaacggacccgtaacccgggtttaaccgacccccggttaaacccttccggggttaacccttaccccgg

SEQ ID NO: 149759 - DNA, 822 bp, Homo sapiens
  misc_feature: GYAE6OF02F3QS2.24.81.H04.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (508)..(508): a, c, t, g, unknown or other
  misc_feature (508)..(508): n is a, c, g, or t
tcagactactatgtcacgaccggtgctcgatttagtagtgtagattcgcgggggggggtctcaggaggcagcgctctcgggacgtctccaccatggcctgggctctgctattcctcacctctcactcgagggcacagggtcctgggacccagtctgaccctgactcaaccgtnccgtccgtgtccngggtctccgtgacagtcgatccaccattcgtcctgaccacgttcgaccaaccgatcgaacgtcgtacctttggtacttagtttaacttaaggtttcgttcctccgtagggttactacgaaccgaaccgtaacccgacgggaaacccaaaccggaaccccccgtaaactactaacgttagttaaacgtttgacgttaagtcggtactaagtaaccgttccgggacccttaccggaggggtccttaggtacgtacgtcgttccgttacgtctacggcctaccggtagtccgtacgaccgaccgaccggttccctaaaccccgtntaacccgtacgtttccgacccggtttacgggtacccgttacggacgggttacgttaacggggtaccgggaaccgggtaacggcggtttaaacggttacttttaacgttacgtaccggttactaccggtttagaacgttacggaaactcggaacacggtattaccgtccgtaccggttccgtttacgggtacccgggttaagggccggtaaaccgtacggaaccggtttacccccgtcgttaccggggttaacccgaccgggttaaacccggaccccgaaccccgggtttaaaccctcgggttaccctaacccgg

SEQ ID NO: 149760 - DNA, 897 bp, Homo sapiens
  misc_feature: GYAE6OF02FLZDD.24.81.H04.1.454.CMB.1.raw
tcagactactatgtcacgaccggtgctcgatttagtagtgtagattcgcggggggggggtctcaggaggcagcgctctcgggacgtctccaccatggcctgggctctgctattcctcaccctcctcactcagggcacgagggtccgtcgggcccagtctgcccctgacctaccaacctcgccctcgtgtcgtgggtcctccgtggacagtacgactccaccatcctcctcgcactacgaccaacctatcgaacgttcgtacctttaggtatttagttttaagttaacgttttcgttcgttacctaggtactaaccaaaaccgaaccaacccgaacggaaccgaaaaccccgaacccccctaaacgtactaattacgttaattttaacgtagtacttacggtaccgtaaacgttaaaccggtccccgggtcccgtaccgggtaggggttccttacgttacggtacgttccttcgtttcccgttcggtccggtcctaccgggttacggtaccgtacgggaaaccgtaaaccccgggtcccgggttacccccccttaaccccggtaccgtaacccgttaccgttaccggtcccgggttaccgggggtacccctttcccggggtaaacggggtccggttaaacggggaaccggggtaacccggtaaccgggttaccgtttaacggttaactttaaccgttttaggttacgtacgttacgtttaacgagggtacccgaagacgtaacgcggtacacgggttcccgttaccgtacgttaccgggtaaggttacccggacggtaacccggtaaggtcccgtaccccgggttaccggtaccggtaaacccggtaccccggacccggtaacccgaaccccgttaaccgaccggttacgttaacccg

SEQ ID NO: 149761 - DNA, 844 bp, Homo sapiens
  misc_feature: GYAE6OF02JZIZW.24.81.H04.1.454.CMB.1.raw
tcagactactatgtcacgaccggtgctcgatttagtagtgtagattcgcgggggggggggtctcaggaggcagcgctctcgggacgtctccaccgatggcctgggctctgctattcctcaccctcctcactcgagggcacgacgggtcctcgggcccagtcgtcgcccctgacctacaacctgccctccgtgtcgtcgggtctccgtggacagtcgatcacctatccgtcctcgactacgtcgaccaaacctataccgaacggttcgttacctttagtaattttagttttaatttaacggttttcgttaccttccgttaggttaactaaccgtaaaccaaccgtaacccgaacggtaaccgaaaaccccaccccccgtaaaatacctaagttagtaactttaacgtacgtactacgtaacaaacggttaaccgtccggtacccgtacggtaacgggttccttacgtacgtaccttccgtacttccgtccgtcggtcctaccgtaggttccgacgtaccgaaccgtacccgtccctacccgtacgaccctacgtcccgttacgtcgggtacctaccggtacggtccgaagggacggtaccggaacgtacgtaacgttaccttaattcggtacgcgttaccgtacgtaacgccggtaaacgacgaccgtaacggcccgttaaggttacccggtcccggttaacggttaccgggttaacgggtaaccggtccggtaaacccgtaccgggttaacccgtaaccgggttacccgtaccgggtaaccctacccggtaaaccccggtaaaccccggtaccccaaacccggttcccgtacccggttaacccg

SEQ ID NO: 149762 - DNA, 871 bp, Homo sapiens
  misc_feature: GYAE6OF02IWD08.24.81.H04.1.454.CMB.1.raw
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtcngccctgactcgaacctgcctcgtgtctggtctcctggacngtcgatcaccatctcctgcactgcaaccntcagtgaccttgacttgtttaagttagtttgtcctccgttgtatacaaacaaccaccgtaagacaaaccgacccccaaactcagtactatttacagtatcgtatacggtacgcccggtccgtacggacgggtctttgacgtacgttccgtacttctcgtacgtcccgtacgtacggtctcggtacctaaaccgccgtacccctcccgtaccgtacctaccgttccgtccggtacggtcccgtaccggtggtacccgtaaggggtaaccggggtaacggacggttacgttaacccgttaagttttaaccgtttagtttacccggtacgtttagggttaccgttaacggtaaccggaacgtaaccgtaaacgtccggttaaccccggtttaagggttccccgtttaaaccccgggtacgggttttaaccccggggtttaaggggaaccccggggttttaaccccgggtaaacccggtaaccccggggtttttacccccgtaaaacccggggttttccccccgggggtttaaacccgggttacccccggaaaaccccccgggttcccccggtaaaaaaacccccccggggggtttacccccccctaaaaccccccgggttttccggtttccccccgtttaaacccccggg

SEQ ID NO: 149763 - DNA, 794 bp, Homo sapiens
  misc_feature: GYAE6OF02HDM9Y.24.81.H04.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagactactatgtcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcgaacctgcctccggtgtctgggtctcctggacaggtcatcacctatctcctgcagtgaccaaccgatcaagtnaccttgattggttataggtttntctccgtaggtatacaacaaccaccgaggaccaaacgcccctaaactcatacgtatttactaggtatacgtactaaggttaactccggcccgttacgtacggggtctttaccgtgtaaccgttcggtacctttcgtccgtggcctacgtcggtcgtcggaccgtaaccgtaccggtccctcccgtacgacccgttaagttcccgtccggttacgggggtccctaccccgggtaacggtcggttaacgggaacggggggtaacctaggggtcccttggttaaaccttttaggttaacgttttcggaacgtttaaggtttacccgtaacgttacggggtaaaccctaagggtccgaaacggtcgttacgtacccgggtttacccggcctttacgggttaccggaagggttccccgggttaaacggaacccgggtttaccggtaccccggttaacccgggttaccgggtaacccgtaccggtaaacccccgggtaaccgtacccccgggtaaacccctacgttacccgttaaccccg

SEQ ID NO: 149764 - DNA, 723 bp, Homo sapiens
  misc_feature: GYAE6OF02G5NDX.24.81.H04.1.454.CMB.1.raw
  modified_base (215)..(215): a, c, t, g, unknown or other
  misc_feature (215)..(215): n is a, c, g, or t
  modified_base (331)..(331): a, c, t, g, unknown or other
  misc_feature (331)..(331): n is a, c, g, or t
tcagactactatgtcacgaccggtgctcgatttagtagtgtagattcgcggggggggggtctcaggaggcagcactctcgggacgtctccaccatggcctgggctctgctattcctcaccctcctcactcagggcacagggtcctgggcccagtctgccctgactcaacctgcctccgtgtcgtgggtctccgtggacagtcgatcacctatccncctgcactgactaaccatcagtcgaccttgattcgtttataagttgtcctctaggtactacaaacaaccaccgaagaccaaaccgacccccaaactacatagtatttagtagattntactagttaacgtccggacccgtcgtacgggtctcgtgtcgtctccttctcgtcggtctaccggtcggtaccgtacggtaccaaccggtaccgtcccgttacccgtacgaccctctacccggtccggtcgggtcctacccggacggttcgaacgggacgggaacggacggtaccgttaggtaacctttaatttccggtattacgtacgtacgtaagtaaccgggaactaacggtacgaaccgtacgtacgtacccggttaccggttacccgttacgtacggggtaccggtacggggtaaccgtaaccgggttacccttaccggtccgttaccgtaaccggtaccccgaaccggtaacccgtaaccccaacccgttaccctaacgttaccccg

SEQ ID NO: 149765 - DNA, 1125 bp, Homo sapiens
  misc_feature: GYAE6OF02HOOI2.24.81.H04.1.454.CMB.1.raw
tcagactactatgtcacgaccggtgctcgatttagtagtgtagattcgcgggggggggtcttcaggaggcagtacgctctcgggacgtctccaccatggcctgggctctggctattcctcaccctcctcgactcagggcacagggtcctgggcccagtctgccctgactcaacctgcctcgtgtctggtctctggacagtcgatccaccagtctcctggctacgtcgaccaaacccgtattaccgaggttcggaaccttggacttttaggttttaacttaaagttttcgtaccgttccgttaggttaacttaccgaaaaccgtaaaccgaacccctaaggaccgtaaaaacccgtacccccctaaaacttactaacgttaacggtaacttttaacgtacggtaacgttacgttaaccgacggtttaaacgtacccggggttaccccttacgggtaacggggttaccttttaccggtaaggtaacgtttccggttaacccgtttaccgttccggtacggggttaccccttccgtaacggggtttacccgtaggggtaaccccgtaaaacgttaccccgggtccccgtttaccccggtaacgtaacccccgttaaggtttacccggttacccgggtttacgggggaaccccttaccccgggtaacgggttaccccggttaacggggggaaaccggggttaaacccggggtaaccggggttacccggtttaacgggttaaaacccggttttttacggtttaacccggtttttaaacccgggtaacccgggttttaaaccgggtttacccgtttaaaccggggttaaccggtaaaaccccgggttaaacggttaaaccccggtaaccgggtaaaccccgggttaacccggtttttaccccgggtttacccccggggttaaccctttttaacccggggggttttccccgaaaaccggggggttttcccggggtaaaacccccgttaccggggtttaacccccgggaaccccgggtttcccggtaacccgggttttaaaccccggaacccggggttacccccgggaaaaaccccggttacccccccgggaaaaccccccggtttttccgggtaacccggtttaacccccgg

SEQ ID NO: 149766 - DNA, 512 bp, Homo sapiens
  misc_feature: GYAE6OF01EHY22.19.14.B03.1.454.CMB.1.raw
  modified_base (356)..(356): a, c, t, g, unknown or other
  misc_feature (356)..(356): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctggtaccaacaacaccccaggcaacggccccaaagtacatgatttatgatgtcagtgagcggcccgtcacggggtccgtgatcgcttctctgctccagtcnggcaacacggcctcctaaccatctctgggcctcacggctgacggatggagcgtgatttattactgctgctcatatgcaggcaggtactagtttggtacgttcggccgggtagggaccaagcgtcgaccggttcctagggtcacgcccgaaggcccg

SEQ ID NO: 149767 - DNA, 503 bp, Homo sapiens
  misc_feature: GYAE6OF01BDNL9.19.14.B03.1.454.CMB.1.raw
  modified_base (362)..(362): a, c, t, g, unknown or other
  misc_feature (362)..(362): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagcggccctcaggggtccctgatcgcttctctggctccaagtctggcaacncggcctccctaaccatctctgggctccaggctgaggatgaggctgattattactgctgctcatatgcaggcaggtacacttttgggtattcgggcggtagggaccagctgacccgtctaggtacacggcccaagggtcccg

SEQ ID NO: 149768 - DNA, 671 bp, Homo sapiens
  misc_feature: GYAE6OF01C600Q.19.14.B03.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatggttggtggttataactatgtctcctggtaccaacaacaccaggcaacggccccaaagtcatgatttangatgtcagtgagccggcctcgacgggtccctgactcgtcttctctcggcctcaagtctggacaaccgaccggccctaccctaaccactcctccgtcgggccttccgacggtcgtggaaggacgttggaacggtccgttaggtaatttaacgtttacgtcgtcgttcggaccttacgaattacgttcggacgtaacgggtaccgtaacgggtttaccttaccggtttttaggggttaccgttttaccgggggaccggggtaaacggggtaaccccgtaaacgggtcccgttaaccgggtaacccccggttacccggttaaccggggttacccgtaacccgggtacccccggtaaacggggttccccccgg

SEQ ID NO: 149769 - DNA, 519 bp, Homo sapiens
  misc_feature: GYAE6OF01BHSN6.19.14.B03.1.454.CMB.1.raw
  modified_base (396)..(396): a, c, t, g, unknown or other
  misc_feature (396)..(396): n is a, c, g, or t
tcagtactctcgtgcacgaccggtgctcgatttagtgtgagtagttccgcggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagcggcctcgaggggtccctgatcgcttctctggctccaagtctggcaacacggcctccctaacatctctggctccaggctgaggntgaggctgattattactgctgctcatatgacaggcaggtactacgtttggtatttcgggcggtaggggaccaaggccgtggaacccggttcctagggtaccacggtccccgaaagggtccccg

SEQ ID NO: 149770 - DNA, 507 bp, Homo sapiens
  misc_feature: GYAE6OF01E20TT.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgattatgatgtcagtgagcggccctcgaggggtccctgatcgcttctctggctccaagtctggcacacggcctccctaaccatctctggctcaggctgaggatgagctgattattactgctgctcatatgcaggctaggtacacgttttggtacgttcgggcggagggaccaaggcctggaccgtcctagggtaccacgcccgaaggtcccg

SEQ ID NO: 149771 - DNA, 545 bp, Homo sapiens
  misc_feature: GYAE6OF01B9NT7.19.14.B03.1.454.CMB.1.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatggttggtgttataactatgtctctgtaccaacaacaccagcaacggaccccaaagtcatgatttangatgtcagtgagcgcctcgacgggtcctgactcgcttcnctggctcaagtctggacaacgccggccctaccctaaccatcctcgtcgggcctcgaaggcctaggaggtatggaggcttaggtatttattacgtgcttgctacaatatgcgtaggactaaggttactacgtttaggtacgttcgggacggaagggaccctaaggccgtaggtacccgtcgtaacggtacgaccgcccgaaggtccccg

SEQ ID NO: 149772 - DNA, 508 bp, Homo sapiens
  misc_feature: GYAE6OF01EQ97C.19.14.B03.1.454.CMB.1.raw
  modified_base (378)..(378): a, c, t, g, unknown or other
  misc_feature (378)..(378): n is a, c, g, or t
tcagtactctcgtgcacgaccggtgctcgatttagtgtgagtagttccgcggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggccccaaagtcatgatttatgatgtcagtgagcggccctcagggtccctgatcgcttctctggctccaagtctggcaacacggcctaccctaaccatcnctggctccagctgaggatgagctgattattactgctgctcatatgcaggcaggtactactttggtaattcgggcggaagggaccaaggcctgaacccgttcgtaacggtcacggtccccgaaaggtcccg

SEQ ID NO: 149773 - DNA, 618 bp, Homo sapiens
  misc_feature: GYAE6OF01CRTH2.19.14.B03.1.454.CMB.1.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctctgtaccaacacaccagcaacggccccaaagtcatgatttangatgtcagtgagcggcctcgacgggtccctgactcgtcttctcgtggcctcgaagtctacggacaaccgaccggccctaccctaacctctaccgttccgtcgggacctcccgacggtcctaggacggtagtacggacggtcttagtaactttacgttaccgtgtcgttcgtacctcgtaatagtcgacgacgggtccgtaacggttacctacggttttagggtacgttccggggcgggtaacgggaacccgtaaggtcccgttacggtaccccgttaccggttaacgggttacccgaaccggtcccggtaaaggtcccccgg

SEQ ID NO: 149774 - DNA, 576 bp, Homo sapiens
  misc_feature: GYAE6OF01BNJOO.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgtggtgttataactatgtctctgtaccaacacaccagacaacggccccaaagtcatgattatgatgtcgtagtcgacggccgtccgtacggtccggtccgtagtcgtcgttctcgtcgtcgtcctacgtacgtcgtacgacaccgaccgtaccctacctaactcgtactcggtcgtccgtacgacgtcgtacgagtgtacggcgtatagttagttactacgtcgtcgtcgtactatagttcgacgagtacgtacgtacgtacgttacggttaggttacggtacgggacggtaacgacgtacgtcgtaccgtaccgtacgtacgacgaccgacggcgtaccccg

SEQ ID NO: 149775 - DNA, 699 bp, Homo sapiens
  misc_feature: GYAE6OF01EZHFV.19.14.B03.1.454.CMB.1.raw
  modified_base (251)..(251): a, c, t, g, unknown or other
  misc_feature (251)..(251): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcaccatctcctgcactcggaaccagcagtgattgttggtgttatactntgtctctgtaccaacacaccagcaacggccccaagcatgattatgtatgtacagtgagccggcccgtcgacgggtcctagacgtccgtctttcgtcgtcggtcctaccgaacgttccgtaggacctaaacccggtaccggtaccccttacccctaaccctacgttcccgtaccgtcgggtaccccttacccggaacgggtccgtagggtaacggtaacgtcgggtacggtccttaggttaacttttaacgttaccgttcgtacgttcggtaccttactaagttacgtacgtaccggtacggtaccggttaacggtaacctttacgggttttacgggttaacggttaccgggggtaccgggtaacgggggtaaccctaacgggttccgtaaccgggtaccccggttaccggtaacgggtacccgaaccggtcccggaacggtcccccgg

SEQ ID NO: 149776 - DNA, 523 bp, Homo sapiens
  misc_feature: GYAE6OF01CK01W.19.14.B03.1.454.CMB.1.raw
  modified_base (359)..(359): a, c, t, g, unknown or other
  misc_feature (359)..(359): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctggtacaacaacaccagcaaggccccaaagtcatgattatgatgtcagtgagcggccctcgacgggtcctgactcgtcttctctggctccaagtctggcaacncggcctccctaacatctctggcctcaggctagagatgaggctagtattagttactgtacgtgtctctattatgcgaggcaagggtacctagtttggtagttcgggcggtagggaaccaggtcctaggtacccgttccgtaggtccaacgcccgtaaggtccccg

SEQ ID NO: 149777 - DNA, 667 bp, Homo sapiens
  misc_feature: GYAE6OF01C2KVA.19.14.B03.1.454.CMB.1.raw
  modified_base (297)..(297): a, c, t, g, unknown or other
  misc_feature (297)..(297): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgccactggaaccagcagtgatgttggtgttatactatgtctctgtaccaacacaccagcaacggccccaaagtcatgtatttangatgtcagtgacgccggcctcgacgggtcctgactcgtcttctcgtcggctccaagtcgtggaccaacgaccgccctaccctaaccactcctcgtcgggcctccgaggtcctaggacggagtgggaggtcctaggtaactttacgttactggtacttcgtaccttacgtaagttacgtacggaccgtaagggtaccgttaacgggttaaccgtttaccggtttacggggttaacgttacccggggggtaaccggggtaaccgggggtaaaccccgtaaacgggttcccggttaaacccgggttaccccggttaacccggttaaccgggtaacccgtaacccgggacccccgtaaacggggttccccccgg

SEQ ID NO: 149778 - DNA, 570 bp, Homo sapiens
  misc_feature: GYAE6OF01A3BA7.19.14.B03.1.454.CMB.1.raw
  modified_base (225)..(225): a, c, t, g, unknown or other
  misc_feature (225)..(225): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtggttataactatgtctcctggtaccaacaacaccaggcaacggccccaaagtcatgatttatgatgtcagtgagcggccctcgacggggtccctgatcgcttctcgtggctccaagtctggctaacncggccctaccctaaccnctcctcgtcgggcctcccgaggtctggaggatggaggtctagtatttacttactgctgcttcatagtgacaggactaagggtactagttttcgggtacgttccggggacgggtaacgggtaacccaaggccgttacggaaccccggttaccgtacggggtaccaaccggtccccgtaagggtccccg

SEQ ID NO: 149779 - DNA, 569 bp, Homo sapiens
  misc_feature: GYAE6OF01B4545.19.14.B03.1.454.CMB.1.raw
  modified_base (225)..(225): a, c, t, g, unknown or other
  misc_feature (225)..(225): n is a, c, g, or t
  modified_base (446)..(446): a, c, t, g, unknown or other
  misc_feature (446)..(446): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctcctggtaccaacaacaccaggcaacggccccaaagtcatgatttatgatgtcagtgagcggcctcgacgggtcctgactcgcttctctggctcaagtctggcaacgcgcctccctaaccatcctctcgggtcctcccgaggtcctggacggtagtggaggtccttagtatttacgttactcgtctgtccttnattactgcgaggctaaggttacctacgtttggtagttccggggacggtaggggtaaccctaagggtttccggacccggttccgtaacgggtccaacggtccccgtaaggtcccgtacccccgg

SEQ ID NO: 149780 - DNA, 636 bp, Homo sapiens
  misc_feature: GYAE6OF01CRT6V.19.14.B03.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtgagtagttccggcgggggggtctcaggaggcagcactctcgggacgtctccaccatggcctgggctctgctcctcctcagcctcctcactcgagggcacgaggatccgtggctcagtctgccctgactcagcctcactcagtcgtccggtctccgtggacagtcagtcaccatctcctgcacgtgaaccagcagtgatggttgtgttataactatgtctctagtaaccaacaaccaccgagaccaacggacccctaaagtctaagtgtaactttagngtaatcgtacgtagtgacggtccggtaccgtcggtaacgggtcctaggtactccgtcttcgtcgtacggcctaccgtaacggttcgtacggaacctaaccgtaccgggtacccttaccgtacgaacctaacgttccgtacggtcgggtccctacgacggtacgtagggaacggtaccggagtacgtagtacttaacgtacgtcgtacttcgactagtactagtcgcgtaggttactactcttacgttacgtcgttacgtacggtacgtacggtaaccctaggtcctaccggtcgtacgacgaccgtaccgaacgtaccccg

SEQ ID NO: 149781 - DNA, 613 bp, Homo sapiens
  misc_feature: GYAE6OF01DBQP0.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtccaccatcctcctgcactggaaccagcagtgatgttggtggttataactatgtctcctgtaccaacaacaccagcaacggccccaagtcatgtattatgatgtcagtgagcggccctcgacggggtcctggactcgtcttctcgtcggtcctcctaacgtcgtcgggacccaaacgacccgggtaccccttaccccgtaacctacgtccgtccgttcgggccctcccggaaggtccgttaggacggtagtggaacggtcgtagttatttacttacgtgcttgcttacagtcgcgcgaacggcgtaaggttaccgttacgtttcgggtacgttcggggacgggtaacggaaccgtacggtaccgtacggacccgttacggtacggtaccgaaccggtccgaacggtccccgg

SEQ ID NO: 149782 - DNA, 522 bp, Homo sapiens
  misc_feature: GYAE6OF01A1NZ0.19.14.B03.1.454.CMB.1.raw
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctgtaccaacaacaccaggcaacggccccaaagtcatgatttangatgtcagtgagcggcctcgacgggtcctgatcgtcttctctggctcaagtctggacaacncggcctaccctaaccatcctcgtcgggcctcccgaggctggaggatggaggctagtattattactgtctgctcatatgctaggcaggtactagtttggtagttcgggcggtacgggaccaggcctcgacccgttcgtacggtaccacggtcccgaaggtcccg

SEQ ID NO: 149783 - DNA, 529 bp, Homo sapiens
  misc_feature: GYAE6OF01BZCDV.19.14.B03.1.454.CMB.1.raw
  modified_base (298)..(298): a, c, t, g, unknown or other
  misc_feature (298)..(298): n is a, c, g, or t
tcagtactctcgtgcacgaccggtgctcgatttagtgtgagtagttccgcgggggggggtctcagggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctcctgcactggaaccagcagtgatgttggtgttataactatgtctctgtaccaacacaccagacaacggccccaagtcatgtatttangatgtacagtgacgcgcctcgtacgggtcctgactcgtcttctcgtcggctcgaagtctacggacaaccgcgtccctacctaacctatcctcgtcggctaccgaggctaggagagtgaggctagtatttatacgtgctcgctcatatcgacaggactaggtctagtttggtagttcgggacggaggacagccgtacggaccgttacgacgtacgaccgcccgaggtccccg

SEQ ID NO: 149784 - DNA, 697 bp, Homo sapiens
  misc_feature: GYAE6OF01CUY4Y.19.14.B03.1.454.CMB.1.raw
  modified_base (302)..(302): a, c, t, g, unknown or other
  misc_feature (302)..(302): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatggttggtgttataactatgtctcctgtaccaacaacaccaggcaacggaccccaaagtcatgtattangtatgtcagtgagccggcctcgacgggtccctgactcgtcttcgtcgtcggtcctaccgtaagtcgtggaccaaccgacccggtacccttaccccgtaaacctacttccgttccggtcggggtcccttacccggacgggtccgttagggaacgggtagtacgggtaacgggtaccgttaggtaactttttaacgtttaacgttcgtccgttacgtccttaacgtaagttaacgtcggaaccgtacgggtaccgtaacgggttaccgtttacggttttacgggttaccggttaccgggggaccgggtaacgggtaacccgtaaacgggtccgttaccgggtaacccggttacccgtaacgggttaccgaacccggtaccccgtaacgggtcccccg

SEQ ID NO: 149785 - DNA, 631 bp, Homo sapiens
  misc_feature: GYAE6OF01DQCZZ.19.14.B03.1.454.CMB.1.raw
  modified_base (299)..(299): a, c, t, g, unknown or other
  misc_feature (299)..(299): n is a, c, g, or t
tcagtactctcgtgcacgaccggtgctcgatttagtgtgagtagttccgcgggggggtctcaggaggcagcactctcgggacgtctccaccatggcctgggctctgctcctcctcagccctcctcactcagggcacaggatccgtgggctcagtctgccctgactcagcctcactcagtcgtccggtctccgtggacagtcagtcaccatcctctgcactcggaaccagcagtgatggttgtagttataactatgtctctgtaccaacacaccagacaacgacccaagtcatgtattangatgtacagtcgacgccgcctcgacgggtccctgactcgtcttcgtcgtcgtcctacgtacgtcgtacggaccaacgtaccggtccctaccctaacctacttccgtcgtcggtcctacgtacgtcgtaggacggtagtcgacggtctagtactttacttacgtcgtactcggtacttactagttacgtcggaccgtacgggtacgtaacggttaccttacggtttaccgggtaacggttccggggaacgggtaacggtaaccgtaacggtcccgttaacggtaccccggttacgttaacgggaccctaccggtacccggtaggtacccccgg

SEQ ID NO: 149786 - DNA, 641 bp, Homo sapiens
  misc_feature: GYAE6OF01DFR8O.19.14.B03.1.454.CMB.1.raw
  modified_base (302)..(302): a, c, t, g, unknown or other
  misc_feature (302)..(302): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctagtaccaacaacaccaggcaacgccccaaagtcatgtatttangatgtcagtgagccgccctcgacgggtcctgactcgtcttctcgtcggacccctaaggtccgtcgggaccaaaccgtaccggtcccttaccccgtaacctaacttcccgtcgttcggggtcctaccgacgggtcctagggaacggtacgtgggtaggtccgttagtacttttaacgtttacgtgtccttggtccttactaagttagtcggacgtaacgggtactaacgggttaaccgtacggttttagggtacgtttccggggacgggtaacgggacctaaggtccgtacggtacccgttccgtaacgggtaccaccggacccgaaggtccgtccccgg

SEQ ID NO: 149787 - DNA, 616 bp, Homo sapiens
  misc_feature: GYAE6OF01A6OV9.19.14.B03.1.454.CMB.1.raw
  modified_base (227)..(227): a, c, t, g, unknown or other
  misc_feature (227)..(227): n is a, c, g, or t
  modified_base (372)..(372): a, c, t, g, unknown or other
  misc_feature (372)..(372): n is a, c, g, or t
tcagtactctcgtgcacgaccggtgctcgatttagtgtgagtagttccgcgggggggtcgtcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccagtctccgtgcactggaaccngcagtgatggttggtggttataactatgtctctacggtaccaacaaccaccacggacaacggcccccaaagtcatcgatttatgatgtacagtgacggccgccctcgacgggttcctagactcgcttctctcggtctccaacgtntacgacaacgaccggtcctaccctaactactctcgtcggctccgacgcgtcgaaggtactggacgtcgtatactttacttaacgcgtacgttcgaccgtttcaagtttaacgtcggactaaggggtaccgtaagggtttacctaccggttttagggttaaccggttccggggacggggtaaacgggaccctaaggcccggttagtaacccggtccgttacggactaccggacccgttagggccc

SEQ ID NO: 149788 - DNA, 741 bp, Homo sapiens
  misc_feature: GYAE6OF01CVSR1.19.14.B03.1.454.CMB.1.raw
tcagtactctcgtgcacgaccggtgctcgatttagtgtgagtagttccggcgggggggggtctcaggaggcagcactctcgggacgtctccaccatggcctgggctctgctcctcctcagccctcctcactcagggcacaggactccgtgggctcagtctcgccctgactcagcctcactcagtcgtccgggtctccgtggacagtcagtcaccatcctcctgacacgtaggaaccagcagtgattggttggtagttataactatgtctccgtagtaaccaacaccaccgagaccaacggaccccaaagtcatgtattatgatgtcagtcggacgtcggcccgtacggacgggtcctagacgtccgtcttcgtcgtacgtccgtactaacggtctacggaccaaaccgtacccggtaccccttaccctaacctcgtccgttccggtaccggtaccctacccggtaacggtccggtaaggacggtaggtacggtacggtacgttaacggttaagtttaacctttacgtccgggttacctaggttcccttaagtaaacgtcgtaacggtaccgggtaacgggtacgttaaccgggtttaacggtttaccggtttagggtttacgggtacccgggggaaacggtaccgggtaaaccctaacgggttccccgttaccgggttaaccccgttaccgggtaaccggttacccggaaccccggtaccgggtaccccggttaccccggg

SEQ ID NO: 149789 - DNA, 586 bp, Homo sapiens
  misc_feature: GYAE6OF01AG32I.19.14.B03.1.454.CMB.1.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (379)..(379): a, c, t, g, unknown or other
  misc_feature (379)..(379): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttatactntgtctctggtaccaacaacaccaggcaacggccccaaagtcatgatttatgatgtcagtgagcggccctcgacgggtccctgactcgtcttctctcggctcaagtctggacaacgccggcctaccctaacntcctcgtcgggcctcccgaggtctaggaggacgtggaggtcctaggtaactttacttacgtgcgttgtccttacattacgtcgacgtacgggtacgtaacggttaccttacgttttagggtacgtttccggggacgggtacgggaaccctaaggtccgttacggacccgttaccggtacggtacccaacggtcccgaagggtccccg

SEQ ID NO: 149790 - DNA, 710 bp, Homo sapiens
  misc_feature: GYAE6OF01BBL0Z.19.14.B03.1.454.CMB.1.raw
  modified_base (307)..(307): a, c, t, g, unknown or other
  misc_feature (307)..(307): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctgaacagtcagtcaccatctcctgcactggaaccagcagtgatgttggtgttataactatgtctcctaggtaccaacaaccaccaggaccaacggaccccaaagtcatgtatttangatgtcagtgagccggcctcgacgggtccctgtactccgtcttctcgtcggtcctaccgaacgttcgtcggacctaaaccgccggtacccctacccctaaacctacgttcccttaccggtcgggtcccttacccggaacgggtcctaacgggaacgggtagtacgggacggtccgttaacggttaacttttaacggtttaacgtcggtccgttacggtccttaacgtagttacggttacgtacggaacggtaccggttaacggttaaccgtttacggttttacgggttaacggtttccgggggaacggggtaaaccgggtaacccgtaacggtccgttaaccgggtaaccccggtttccggtaaccgggtccaaacccgggtaccccgtaacgggtacccccg

SEQ ID NO: 149791 - DNA, 651 bp, Homo sapiens
  misc_feature: GYAE6OF01DSEXZ.19.14.B03.1.454.CMB.1.raw
  modified_base (300)..(300): a, c, t, g, unknown or other
  misc_feature (300)..(300): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttatactatgtctcctggtaccaacaacacccagcaacggccccaaagtcatgatttangatgtcagtgagtcggcctcgacggggtcctgacttcgtcttcgtctgtcctaccacgtcgtcggacaaccgccggtccctaccctaacctacttccgtacgtcgggtcctacccgagggtcctagggacgggataggtacggtccgttagtaacttttaacttaccgtgtccgttcggtcccttacgtaattacgtcggtacgtaacgggccgttaagggttaaacccttcggttttacgggttaccggttaccgggggaaccggggtaacgggaacccgttaaggacccgttacggtaacccggttcccgtaacgggtacccgtaacggacccccgtaagggtcccccg

SEQ ID NO: 149792 - DNA, 521 bp, Homo sapiens
  misc_feature: GYAE6OF01BKH8D.19.14.B03.1.454.CMB.1.raw
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgtggtgttataactatgtctcctggtaccaacaacaccaggcaaggccccaaagtcatgatttangatgtcagtgagcggccctcgacgggttccctgactcgtcttcgtctggctccaagtctggccaacacggccctaccctaacactctctgggcctcaggctggagatggaggtctgtattnttactgctgctcgtatagtgcaggcgaaggtactacgttttggattcggggcgggaggaccaggtcctagacccgttcgtaggtacacggcccgaggtcccg

SEQ ID NO: 149793 - DNA, 594 bp, Homo sapiens
  misc_feature: GYAE6OF01BIGJC.19.14.B03.1.454.CMB.1.raw
  modified_base (289)..(289): a, c, t, g, unknown or other
  misc_feature (289)..(289): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcacatctcctgcactggaaccagcagtgatgtgtagttataactatgtctctgtacaacacaccagcaacgcccaagcatgattangatgtcagtgagcggcctcgacgggtcctagactcgtcttctcgtcggtcctaccgaagtctacggaccaacgtaccggtccctaccccgtaactacttcctcgtcgggccttcccgagggtcctaggaggtatcggtacggtcttaggtatttacgttactggtacctgtactcaagtacgttgacgagggtactacggttaactcggtttacggtacgttcgggacggtaaggggtaacctaacgggtccgtacggtacccggttaccgtacggtacccgaacgtccccggtaacggtccccg

SEQ ID NO: 149794 - DNA, 537 bp, Homo sapiens
  misc_feature: GYAE6OF01EBZF9.19.14.B03.1.454.CMB.1.raw
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctgtaccaacaacaccagcaaggccccaaagtcatgatttangatgtcagtgagcggccctcgacggggtccctgatcgcttctctggctccaagtctggcaacncggcctccctaacatctctggctccaggctgaggatgagctgattattactgctgctacatatgcaggcctaggtactacgttttgggtaagttccggggacggaggggaaccctaagggaccttacgggaccccggttcccgaaacgggttccaacgggtaccccgaaagggtccccg

SEQ ID NO: 149795 - DNA, 617 bp, Homo sapiens
  misc_feature: GYAE6OF01CIDO5.19.14.B03.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtcgtccgggtctcctggactagtcagtcacctatcctctgcactggaaccngcagtgatgttgtgttatactatgtctcgtgtaccaacaaccaccgagcaacgaccccaaagtcatgtattangtatcgtcgagtcggacgccggtccgtcggacgggttccctgtactccgtcttcgtcgtcggtctaccgtacgtcgtcggacctaacgccgtccctaccctacgtactctacgtcggacctcgaggctacgagtctcggagtcttgtaactttcgtacgtcgtcgtacgtcctacgaattcggtcgtacacgggtactaaccggttccgtacggtttacggtaccggttcgggaccgggtaagtaacccgcggttaccggttaaccggtaccgtccggttaacggtcctaacccggtaccggtacgtacccccgg

SEQ ID NO: 149796 - DNA, 695 bp, Homo sapiens
  misc_feature: GYAE6OF01DPZY8.19.14.B03.1.454.CMB.1.raw
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagtactctcgtgcacgaccggtgctcgatttagtgtgagtagttccggcgggggggggggtctcaggaggcagcactctcgggacgtctccaccatggcctgggctctgctcctcctcagcctcctcactcgaggggcacgaggactccgtgggcctcacggtctcgccctgacctcacgtcctcactcgagtcggtccgggtctccgtggacngtcacgtccaccatcctcctgcacgtacggaaccagcagtgagttggttggtagtatactatcgtcctcgtagtaaccaacaaccaccgagaccaacggaccccaaagtcatntattangtatgnagtgacggccgccgtacggacggtcctagtctcgtcttctacgtcgcctactacggtctacgggactaaccggtacccgtccccttaaccgtaacctccgtacgttccggacggtccctaccggtaggtcgtagggaacggtagtacgggtacgtagttaacgttacgtttaacgtacggtcgttcgtacgttacctaacgttaagtcgacggacggtacggtacggtaaaggttacctttacgggttacgggtaacggttacggggaccgggtaacggtaacggtaccgtccggttaaccggtacccgggtaaccgtacggtacccgtaacccggccgttaccgggtcccccg

SEQ ID NO: 149797 - DNA, 508 bp, Homo sapiens
  misc_feature: GYAE6OF01AZG41.19.14.B03.1.454.CMB.1.raw
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagccggccctcgacggggtccctgatccgcttctctggctcaagtctggcaacncggtccctcctaaccatctcgtggcctccaggctgaggatggaggctgattatactgctgctcatntgcaggcaaggtactcgtttggtagttcggcggagggaccagccgtacgaccgtcgtaggcacgcccgaggtcccg

SEQ ID NO: 149798 - DNA, 691 bp, Homo sapiens
  misc_feature: GYAE6OF01D06W1.19.14.B03.1.454.CMB.1.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctcctgtaccaacaacacccaggcaacgccccaaancatgatttangatgcagtgagcggccctcgacggggttccctgactcgtcttctcgtcggctccaagtcgtcggaccaaaccgaccggtacccttacccctaaccgacttcccgttaccgtcggggtcccttcccggaaggtccgttagggaagggtacgttagggaacggtccgttaaggttaactttttaacgtttaacgttcggttacttcggtccttacgtaacgtttaagtcggacgtaacgggtaccgtaagggttaacccgtttaacggttttcggggttaacgtttccgggggaacgggtaaccggggtaaccggtaaacgggccgttacccgggaacccggttcccggttaaacgggacccgtaacccgggaccccgtaaagggttcccccgg

SEQ ID NO: 149799 - DNA, 718 bp, Homo sapiens
  misc_feature: GYAE6OF01D0Q13.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtagttataactatgtctcctggtaccaacaacacccaggcaacggccccaaagtcatgatttatgatgtcagtgagcggaccctgacggggtccctgatccgtcttctcgtggacctccaagtcctaggacaacgaccggtacccttaccccgtaaacctacttccttccgtcggggccttaccccgagggtccgttagggaaccgggtatacgggtaacggggtccttaaggttaatttttaagtttaaccccgttgggtaccgttcggtaccgttactaacgttaggttacgaccggtaacgggtacccgttaacggggttaaaccctttaacggttttttacgggggttaggttttacccggggggaaccggggtaaacgggggtaacccctaaagggtaccccgtttacgggaacccccgggtttacccgttaaacggggttcccgaacccggtccccggtaaacggtccccccgg

SEQ ID NO: 149800 - DNA, 496 bp, Homo sapiens
  misc_feature: GYAE6OF01DNOKS.19.14.B03.1.454.CMB.1.raw
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttgtgttataactatgtctctgtaccaacaacaccaggcaagccccaaagtcatgatttatgatgtcagtgagcggccctnagggtccctgatcgcttctctggctccaagtctggcaacacggcctccctaaccatctctggctccagctgaggatgagcngattatactgctgctcatatgctaggcaaggtacacgtttggtattcgggcgaagggccaaaggtctgaacccgtcctaaggtccaacgtcccgaaggtcc

SEQ ID NO: 149801 - DNA, 531 bp, Homo sapiens
  misc_feature: GYAE6OF01A5I1G.19.14.B03.1.454.CMB.1.raw
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (389)..(390): a, c, t, g, unknown or other
  misc_feature (389)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctggtaccaacaacacccaggcaacggcccccaaagtcatgatttatgatgtcagtgagcggccctcgacggggtccctgatcgcttctctggctcagtcnggcacncgcctccacntctctggctcagctgngnngngntgnttatactgctgctnatatgcaggctaagggtactacgttttaggtagttccggggcgggtaacgggacctaaggtcccgttcggtaaccccgttccggttaacggtacccgaacggtccccgtaagggtccccg

SEQ ID NO: 149802 - DNA, 706 bp, Homo sapiens
  misc_feature: GYAE6OF01BVVTA.19.14.B03.1.454.CMB.1.raw
tcagtactctcgtgcacgaccggtgctcgatttagtgtgagtagttccggcggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctctgcactggaaccagcagtgatggttgtgtatactatgtctctgtaccaacaacaccagacaacggccccaaagtcatagtatttatgatgtcagtgacgccggcctcggacgggtcctagactcgtcttcgtcgtcggcctaccgaacgttcgtacggaccaaccgaccggtccccttaaccctaacctaaccttccgtccgtcggtccgtacccgtacggtccgtaggtacccccccggtagtacggtacggtacgttacgtaacgtttaacgtttacgttacgtacgttcgtaccgttaccgtaacgttacgtacggtacggtaacgggtacggtaacgggttaaccgttaacggttttacgggtttaacggttaccggggtaaccggggtaacgggtaacccggtaacggtaccggttaccgggtaaccccggttacccggttaaccgggttaacccggtaacccggtaccccggtaaccgggttaccccgg

SEQ ID NO: 149803 - DNA, 613 bp, Homo sapiens
  misc_feature: GYAE6OF01CL01D.19.14.B03.1.454.CMB.1.raw
  modified_base (171)..(171): a, c, t, g, unknown or other
  misc_feature (171)..(171): n is a, c, g, or t
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctnactcagtgtccggtctcctggacagtcagtcaccatctcctgcactggaaccngcagtgatgttggtgttataactatgtctcctggtaccaacaacacccaggcaacggcccccaaagtcatgatttangatgtcagtgagcggcctcgagggtccctgactcgcttctcgtggcctcgaagtcgtggccaacgccggccctaccctaacctatcctcgtcgggcctccgaggctaggacggtagtggacggtctaggtaactttagttaacgtggtcttcgaccttacgtaagttacgtcggaccgtaacggccgtaacgggttacctacggttttacgggtacgtttccggggacgggtaacgggtaaccctaaggtttccgaaccccggttcccgttaacggtaccaaccggtaccccgaaaggtcccgtaccccggg

SEQ ID NO: 149804 - DNA, 618 bp, Homo sapiens
  misc_feature: GYAE6OF01BNJ9J.19.14.B03.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagtactctcgtgcacgaccggtgctcgatttagtgtgagtagtttggggtttagggggggggtcacgaagaggcagcgctctcgggacgtctccaccatgtcctgggctctgctgctcctcactctcctcactcaggacacagggtcctgggcccagtctcgccctgactcagtctgcctccgtgtctgggtctctggacngtcggcacatctctgcactgaaccagcagtgatgtagaattcgtaacttgtctctgtacanatcaaccaataacncccaaatcatctattacngatcgactatacgcgcctgtaggttactagtcgtctctcgtcgtctacgtagtcgtacgacacgccgtctacccgagaacctactctcgtacggtcctacgacgcgtagacggacgngtctagtattacngtcgtactgctactntagtcgacggttacgtacgttacttacgttctttaaggtccgtttaccggttaacgggacgttaccggggtaaccttacgggtacccgttaaccggttacccggtacggtaccctaacccgggacccggttaaaccggtacccccctaacccggtaccgttccgtaccgttaccccg

SEQ ID NO: 149805 - DNA, 694 bp, Homo sapiens
  misc_feature: GYAE6OF01CXT5L.19.14.B03.1.454.CMB.1.raw
tcagtactctcgtgcacgaccggtgctcgatttagtgtgagtagttccggcggggggggggtctcaggaggcagcactctcgggacgtctccaccatggcctgggctctgctcctcctcagcctcctcactcagggcacaggatccgtgggctcagtctcgccctgactcagcctcactcagtcggtcccgggtctccgtggacagtcagtcaccatcctctcgcaactacggaaccagcagtgagttgttggagttaatactatcgtctccgtaggtaaccaacaccaccgaggaccaaccggaccccaagtcaatcgtattagagtatgtacagtcggacggccggtcccgtacggtacgggtccctagtacgtccgtacttctcgtcgtacctaccgtaacgtccgtacggaccgtaaaccgcccggtacccctacccgttaaacctccgttcccgttccggtaccgggtacccttacccgggacgggtccgtaggtacgggacgtagggtaacggtacttagttaagtttaccttacggtcgtctcgtacctagtattcggagtaccgtagaccgggtacgtttaacgttacgggtttaggtaccggggtacggaccggggtaacggaacctacgggtacgtacccggtccggttaccggtacggaccctacgggacccgcggtaccccg

SEQ ID NO: 149806 - DNA, 613 bp, Homo sapiens
  misc_feature: GYAE6OF01DEHBP.19.14.B03.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (557)..(557): a, c, t, g, unknown or other
  misc_feature (557)..(557): n is a, c, g, or t
  modified_base (604)..(604): a, c, t, g, unknown or other
  misc_feature (604)..(604): n is a, c, g, or t
tcagtactctcgtgcacgaccggtgctcgatttagtgtgagtagttccggcggggggggtctcaggaggcagcactctcgggacgtctccaccatggcctgggctctgctcctcctcagcctcctcactcagggcacaggatcctgggctcagtctgccctgactcacgcctcactcagtcgtccgggtctccgtggacagtcagtcaccatctcctgcacgtaggaaccngcagtgagttggtggtagttataactntcgtctccgtgtaaccaacaaccaccgacggacaaccggaccccaaagtcacgttagtactttagngtatcggtacaggtcggacgccggtaccctcggtaccggggtcctggtactccggtcttccgtcgtcggtcctaccgaacgttcgacggaccaaaccgtcccggtaccctaccgactactacgttcgtcgtacgggccttaccgaagggtcgtacggaggaccggtagtctagtacttctacgtgctnctangtagtcgtacgtcgtacttagtcttgttacgcgttaccggngtaacgtcggaccctaggtccctaccggtcacgtaccgacaccccgngtaaccccg

SEQ ID NO: 149807 - DNA, 533 bp, Homo sapiens
  misc_feature: GYAE6OF01AX45O.19.14.B03.1.454.CMB.1.raw
  modified_base (299)..(299): a, c, t, g, unknown or other
  misc_feature (299)..(299): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctggtaccaacaacaccaggcaaggcccccaaagtcatgatttangatgtcagtgagcggccctcgacggggtccctgactcgcttctctggctccaagtctggcaacgccggcctaccctaacactctctgggcctccgaggctgaggatggaggtctaggtatttagttactgctgctcatatgcaggcaggtactagtttggtagttcgggacggagggacccaaggtccgtacggtacccgtacgttacggtaccgacgccccgtaaggtccccg

SEQ ID NO: 149808 - DNA, 753 bp, Homo sapiens
  misc_feature: GYAE6OF01B310T.19.14.B03.1.454.CMB.1.raw
tcagtactctcgtgcacgaccggtgctcgatttagtgtgagtagttccggcgggggggggtctcaggaggcagcactctcgggacgtctccaccatggcctgggctctgctcctcctcagccctcctcactcagggcacaggatccgtgggcctcagtctcgccctgactcagcctcactcagtcgtcccgggtctccgtggacagtcagtcaccatcctcctgcacgtacggaaccagcagtgagttggttggtagttataactatcgtctcgtagtaccaacaacaccgaggaccaacggaccccaaagtcatcgtatttagagtatgacgagtcggacgtccggccctcggacgggtccctaggtactcgtcttccgtcgtcggtacctaccgtaagtccgtacggacctaacccgtacccggtccccttaacccctaacctcgttacccgttccggtccgggtaccctaccggaacggtccgtagggacggtacggtcggtacggtcttaaggttaacttttacgttacgtcggttcttacgtccgtacgttaagttacgtacgtacggtaacgggtacgtaaccggtttaccgtttaacgggttttacggggttaaccggtttacccgggggaacgggtaacccggggaaccgtaaccgggttccgttaacccgggttaaccccggttaccgggttaacgggtaacccggtaacccgggtaccccgggtaaccggttacccccccggg

SEQ ID NO: 149809 - DNA, 669 bp, Homo sapiens
  misc_feature: GYAE6OF01AU12Z.19.14.B03.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtccaccatcctcctgcactggaaccngcagtgatgttggtgttataactntgtctctgtaccaacacaccngcaacgccccaagtcatgatttangatgtcagtcgacgccggcctcggacgggtcctagtacgtccgtcttccgtcgtcggtcctaccgtaagtcgtacggacctaaccgcccgtaccctaccctaacctacttcctcgtcgggtcctacccgacggtcctaggaggtactaggtacggtcttaggtaactttacgttactcggtactcgtaccttacagttacgtcggacgtaacggtacgtaacggttaccgttacggttttcggggtaaccggtttcgggggaccggggtaaccggggtaacccgtaacgggttacccgttacccgggttaaccccggttaccggttaacgggttaccccaaaccgggtacccccgtaaacggggttccccccg

SEQ ID NO: 149810 - DNA, 656 bp, Homo sapiens
  misc_feature: GYAE6OF01DYQT4.19.14.B03.1.454.CMB.1.raw
  modified_base (319)..(319): a, c, t, g, unknown or other
  misc_feature (319)..(319): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagccctcctcactcagggcacaggatcctgggctcagtctcgccctgactcagcctcactcagtgtccggtctcctggacagtcagtcaccatctcctgcactggaaccagcagtgatggttggtagttataactatgtctcctacggtaaccaacaaccacccgaggaccaaccggaccccaaagtcagtagtatttagngatgtcagtgacgccgaccctcggacgggtcctgactcgtcttctcgtcggtcctaccgagtcgtacggaccaaccgtccgccccttaccctaactacgttcctcgtcgggtcctacggacggtctaggaggtagtggaacggttctagttatttacgttaccgtgtcctagtccttagtaacgttgtacggacgtaacgggtacgttaacggttacctttacgggtttacgggtacggttccggggaccggggtaaccggacgtaaccggtaccggttaccggtaccccgggttacgtaacccggaccgtaacccggtcccgtaacgggtccccgg

SEQ ID NO: 149811 - DNA, 695 bp, Homo sapiens
  misc_feature: GYAE6OF01BUKI9.19.14.B03.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (332)..(332): a, c, t, g, unknown or other
  misc_feature (332)..(332): n is a, c, g, or t
tcagtactctcgtgcacgaccggtgctcgatttagtgtgagtagttccggcggggggggtctcaggaggcagcactctcgggacgtctccaccatggcctgggctctgctcctcctcagcctcctcactcagggcacaggatcctgggctcagtctcgccctgactcagcctcactcagtcgtccgggtctccgtggacagtcagtcaccntctcctgctacgtaggaaccngtcaggtagattggttggtaggttattaactatcgtctccttacggtaaccaaacaaccaccgacggaccgaaccgtaccccaaagtcatacgaatttangtatgtacgagtcggacggtccgtaccgtacggtacggtccgtagacgtccgtcttccgtcgtcggacctacgtaacgtcgtacgaccgaacgtacccggtcctaaccctaacctcgttaccctcgggtaccggtaccgtcccggaaaggtccgtaggaacggtacgtacgggtaacgtcgttaagttaacgtttaaccttagttcgtaaccgttgaaccgttcaacgtttagaccggacgtaacggtacgttaaacgggttacgttacgtttaagggttccggaccggggtacgggacggaaccgtacggtacgtacccggtaccgtaccgttacggacgtaacccgccggtcggtaccccg

SEQ ID NO: 149812 - DNA, 523 bp, Homo sapiens
  misc_feature: GYAE6OF01A2I6S.19.14.B03.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcacatctctgcactggaaccngcagtgatgtggtgtatactatgtctctgtaccacaacaccagcacgcccaagtcatgattngatgtcagtgagccggcctcgacgggtccctgactcgcttctcgtcggcctccgaagtctggaccaaccncggccctacccctaacctactcctcgtcggcctaccgagcctgaggctggtacggctagtactttatactcgntcgctcatntcgcgagtctaaggtactacgttggtacgttacgggcggtaggaccaggtctacgtacccgtcgtacgtaccgacgcccgagtcccg

SEQ ID NO: 149813 - DNA, 595 bp, Homo sapiens
  misc_feature: GYAE6OF01BMMT1.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagcctcctcactcaggacacaggatcctgggctcagtctgccctgactcagcctcactcagtgtccgggtctctggacagtcagtcaccatctcctgcactggaaccagcagtgattgttggtagttataactatgtctcctgtaccaacaacaccagcaacggccccaagtcatgtattatgatgtcagtgacgcggtccttcggacgggtcctgactcgtcttctcgtcggcctcgaagtctcggacaaccgaccggtccctaccctaacctatcctcgtcgggcctccgaggctagaggatggaggtctagtatttacttacgtgtctcgtacgttactagttactcggacgacggtaccgtaaggttaccttacggttttgggtaacgttcggggacgggtacgggaacctaaggcccgttacggtacccgtaccggttacgggtaccaccggaccccggtaacggtcccccgg

SEQ ID NO: 149814 - DNA, 718 bp, Homo sapiens
  misc_feature: GYAE6OF01CWDHV.19.14.B03.1.454.CMB.1.raw
  modified_base (325)..(325): a, c, t, g, unknown or other
  misc_feature (325)..(325): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagccctcctcactcagggcacaggatccgtgggctcagtctgccctgactcagcctcactcaggtcgtccgggtctccgtggacagtcagtccacattctcctgcacgtggaaccagcaggtgatcggttggtagttaataactatcgtctccgtagtaaccaaacaacaccgagacgaacgaccccaaagtcatgtactttagagtntcgtagtagtcgacggccggacccgtcggacgggttcctgtacgtcgtcttcgtaccgtgtacctaccgtaagtcgtacggaccgaaaccgaccggtaccctacctaaacctcgttccgtacgtcggaccttacccgacggtacgttacggacggtagtacggtacggtacgtagttaaacgttttacgtacggtttaccgtccgttaagtaccctttacgtaaggttacgtccggtacgtaacgggtacggttaaaccgttaccggtttaacggttttacgggtacgggtttacccgggacggggtaaacgggtaacccgtaacggttacccgtaccgggttacccgttaacggttaccggtaccgaccggtaaacccgacgggttcccccg

SEQ ID NO: 149815 - DNA, 709 bp, Homo sapiens
  misc_feature: GYAE6OF01DR4XE.19.14.B03.1.454.CMB.1.raw
  modified_base (227)..(227): a, c, t, g, unknown or other
  misc_feature (227)..(227): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtcgtccgggtctccgtggacagtcagtcaccatctcctgcactggaaccngcagtgatgttggtagttataactatgtctcctgtaccaacacaccaggacaacgccccaaagtcatcgtattancgatgtcagtcgagccggcctcgacgggtcctgactcgtcttacgtcgtcggctaccgaagtccgtacggaccaaccgaccggtacccttacccgtaacctacttccgtaccgtcgggaccttacccggtaagggtccgttagggacggtacgtacgggtaacggtcgttacgttaacgttttacgttaaccgttcgtccgttacggacctttacccgaagtttacggtacggtaccgaacgggtaccgtaaacgggttacccgttaggttttaccgggttacgttacccgggggaaccggggtaacgggtaacccggtaaacgggtacccgttaccgggttaaccccggttaccggttaaaccgggtacccgtaaccgggtacccccgtaaaggggttccccccgg

SEQ ID NO: 149816 - DNA, 661 bp, Homo sapiens
  misc_feature: GYAE6OF01DOS6X.19.14.B03.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatccgtgggctcagttctcgccctgactcacgcctcactcngtgtccgggtctccgtggacngtcagtccaccatctcctgacacgtaggaaccagcagtgagtgttggtagttataactatgtctcctacggtaaccaacaacacccgaggacaaccggaccccaaagtcatagtattatgattgacagtgacgccgcctcggacgggtcctgactccgtacttcgtacgtcgactacgtaacgtcgtacggaccaacgtccgtaccccttccaacctactcgtcgtcggacctacccggtaggcgtacggaggtagtacggacggtcttaagtaacgttttacgtactagtcgttcgtaccttacgtaagtacgtacggacgtaacgggtacgttaaccgggttacgtttaacggttacgggttacggtacggggggtacgtaacgggtaacctacggtacccgttacggacccgttaccggtaacggccgtaccgggtaccccgtaggttcccccgg

SEQ ID NO: 149817 - DNA, 721 bp, Homo sapiens
  misc_feature: GYAE6OF01B0OCS.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcacatctcctgcactggaaccagcagtgatggttggtggttataactatgtctcctgtaccaacaacaccagcaacggccccaagtcatgtatttatgatgtcagtgagccggccctcggacgggtccctgactcgtcttccgtcgtcggtctaccgaagtccgtacggaccaaaccgtaccggtaccccttacccctaacctacttccgtccgtcgggcccttccggaacgggtctaggaacgggtagtgggtaacggtcgttaggtaacttttaacgtttaccgtcggtaccgttcgtaccttacgtaattacgtcgggaccgtaaggggtaccgttaacgggttaacccgtttaacggtttttacggggttaacggtttacccggggggacccgggggtaaacgggtaacccggtaaacgggtcccggttaacccgggtaacccccggtttacccgggttaaccggggtaacccgtaaaccccgggtaaccccgggtaaacggggttccccccgg

SEQ ID NO: 149818 - DNA, 599 bp, Homo sapiens
  misc_feature: GYAE6OF01DNLRK.19.14.B03.1.454.CMB.1.raw
  modified_base (342)..(342): a, c, t, g, unknown or other
  misc_feature (342)..(342): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttatactatgtctctgtaccaacacaccaggacacggaccccaaagtcatgtatttatgatgtcagtgacgcgccctgacgggtcctgactcgcttctcgngtcctccaagtcgtgacaacgccggtccctaccctaaccactcctacgtcggcctccgaggtccgtaggacgtatggacggtctaggtatttacttacgtgtcttcgctaccaagttacgtcggacgtacgggactaacgggtaacctttacgtttagggtaacgttccggggaaccgggtaacgggtacctaacggtccgtacggtaaccccggttcgtaaacggttcccgaaccgtccccggtaaggtcccccgg

SEQ ID NO: 149819 - DNA, 674 bp, Homo sapiens
  misc_feature: GYAE6OF01AEQNX.19.14.B03.1.454.CMB.1.raw
  modified_base (226)..(226): a, c, t, g, unknown or other
  misc_feature (226)..(226): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcaccatctcctgcactggaaccngcagtgatgttggtgttataactatgtctcctggtaccaacaacaccaggcaacgaccccaagtcatgtattatgatgtcagtgacgtccggcctacgacgggtcctgactcgtcttctcgtcggcctaccgtaagtcgtggaccacgtaccggtccctaccctaactctctcgtcggtcctaccgacggtcgtaggacggagtacggacggtccgtagtactttaacgttacttcggtacgttcgtacctcgtaattacgtacggtacggtaaccggtaccggtaacggtttacccgttacggtttttaccggggtacggtttacccggggggaccgggtaacggggtaaaccccgtaacgggttcccggtaaccgggtaaccccggtttacccgggtaaccgggttaccggaacccgggtaccccggtaacgggttaccccccggg

SEQ ID NO: 149820 - DNA, 769 bp, Homo sapiens
  misc_feature: GYAE6OF01DRNNZ.19.14.B03.1.454.CMB.1.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (546)..(546): a, c, t, g, unknown or other
  misc_feature (546)..(546): n is a, c, g, or t
  modified_base (621)..(621): a, c, t, g, unknown or other
  misc_feature (621)..(621): n is a, c, g, or t
tcagtactctcgtgcacgaccggtgctcgatttagtgtgagtagtcccggcggggggggggtctcaggaggcagcactctcgggacgtctccaccatggcctgggctctgcctcctcctcagccctcctcactcgagggcacaggactccgtgggctcagtctcgccctgactcacgcctcactcgagtcgtccggtctcgtggacagtcagtcacntctctgactacgtaggaaccngcagtgtagttggttggtacgtttaataacgtagttcgttcctaccgtacggtaaacccaaaccgaaccgacccgacggaccgaaaccggaaccccctaaaaggtcctaagttacgttaagtttacgtgaacgttacggtacgtaggtacggacggtcccggtaccttacggggaccgggtcctaaggtctaccgtctttccgtcgtcggaacccgtaccgtaacgttcgtccgggaacctaccggtacccgtacccctacccgtaacctcgttcgtccggtcggccctaccggtaagcgttacgggngttaacgtcgggtaccggtattacggtttaacttaacctttcggtccgtaggtttccagttacaacgtttacggngttaaccgggacgtaggtaacggtttacgtttaacggttcggggttacccggttacggggaacgggtaccggggaaccctagggccccgttaaaccggccccgtttacggacggttaccccggaacccggtacgtacgttcccccggg

SEQ ID NO: 149821 - DNA, 575 bp, Homo sapiens
  misc_feature: GYAE6OF01D7FUJ.19.14.B03.1.454.CMB.1.raw
  modified_base (300)..(300): a, c, t, g, unknown or other
  misc_feature (300)..(300): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcacatctcctgcactggaaccagcagtgatgttggtagttatactatgtctccgtgtaccaacaacaccagcaacggccccaaagtcatgtattangatgtcagtgagcgcctcgagggtcctgactcgtcttcgtcgtcggctacaagtcgtacggaccaacgaccggtccctaccctaacgcttaccgtcgtacgggtcctacccgaggtctaggacgagtcggacggtctagtatttacttacgcgtctcgctacgtaagtcgtacgacgaggtacgtacggtacttacggtttaggtacgttaccgggacgggtacgaccgtacgcgttacgtacccgtacgtacgtccgacgaccgtcggtccccg

SEQ ID NO: 149822 - DNA, 683 bp, Homo sapiens
  misc_feature: GYAE6OF01E3KLK.19.14.B03.1.454.CMB.1.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (396)..(396): a, c, t, g, unknown or other
  misc_feature (396)..(396): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtagttanaactatgtctctagaccaacaacaccagacaacgcccaaagtcatagtattangatgcagtgacgccggcctcggacgggtccctagtactcgtcttcgtcgtcggcctaccgagtccgacgaccaaccgaccgtccctaaccctaaccncgtcctcggtcggtcctacgaggtctagggtagacgtaggacggtcttagtaactttactacgtcgtcgttacgtacctacgtaacgttagttaccgaccggtaacgggtaaccgttaaacgggtttaccgtttaacgggttttacgggtaacccgggtttacgggggaacccgggtaaccggggaaacccgtaaccgggttccggttaaacccgggtaccccgggttaacccgggtaaccggtaccccgggaacccggtaaccccgggtaaccgggttcccccccg

SEQ ID NO: 149823 - DNA, 837 bp, Homo sapiens
  misc_feature: GYAE6OF01DU9VD.19.14.B03.1.454.CMB.1.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagtactctcgtgcacgaccggtgctcgatttagtgtgagtagttccggcggggggggggtctcaggaggcagcactcgtcgggacgtctccaccatggcctgggctctgctcctcctcacgcctcctcactcgagggcacgaggactccgtgggctcgagtctcgccctgacctcacgcctacactcgtaggttcggtccggttcctccgtggacgacgtcgacgtccaacctctcctccgtcgcgacgtacggaaccngacgtaggtgtagttggttagggttagttaataacgttnttcggtcctacgtaacgtaaccaacaaccgaccgacggaccgaaccgaaccccgtaagtctaagttagtaatttagtagtagtcgtactaggtacggaccggtcccgtcccgtacgggtcggttccctagtacgttcgttcgttccgtcgtccgtacctaccgtaacgtccgtacgaaccgtacccgaccccggtaccctaaccctaacgtccgttccgtaccggtccggtacccgtaccggtacgtacggtggtaacggtacgggttacggtacggttacgtaacgtttaacgtttacgttaacggttccgttaacgttccgtacgtttaacgttacggttacgtaccgggtaacggtacggttaaccggtttaaccggttacgtttacggggtttacccggttacggggttaacccggggggacggttaaacccgggtaaccggttaccggtacccgggtaaccggttaccccggtaccgggttaaccggttaccgggaaccccgggttaacccggcccggggttaccccccggg

SEQ ID NO: 149824 - DNA, 734 bp, Homo sapiens
  misc_feature: GYAE6OF01AUOWH.19.14.B03.1.454.CMB.1.raw
  modified_base (223)..(223): a, c, t, g, unknown or other
  misc_feature (223)..(223): n is a, c, g, or t
tcagtactctcgtgcacgaccggtgctcgatttagtgtgagtagttccgcggggggggtctcaggaggcagcactctcgggacgtctccaccatggcctgggctctgctcctcctcagccctcctcactcagggcacgaggactccgtgggctcgagttctcgccctgacctcacgcctcactcaggtcgtccgggtctccgtggacagtcagtcacatctcngcacgacggaccagcagtgatggttgtacggttatactatcgtctctacggtaaccaactaaccaccgacggaccgaaccggacccccaaagtctaatgttaactttagacgtaacttcgtacgtacggtggaccggtcccggtcccgtaccggtaccgggttaccgtacgtaaccgttccggtccgtttccgtccggtccggttcctaccgttacggtaccggttacggaaccgaacccgtacccggtacccctaccccgttaaaccctcgttaccccggttacgtaccgggtacccgtacccggaacggggtcgtacggggtacggtaacggttacggtaacgggttccgttaagggttaactttaacgtttaacggtcgtacgttccggtaacttacgtacgtaacgcggtaccgacggttacgtacgttacggtacggtttcgtacgggtacggacgggaccgtacggcgtccgacgtcgtacgtacgacgacgtccgacgtcccgg

SEQ ID NO: 149825 - DNA, 750 bp, Homo sapiens
  misc_feature: GYAE6OF01BBMC2.19.14.B03.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatccgtgggctcagtctcgccctgactcacgcctcactcagtcggtccggtctccgtaggacngtcagtcaccatcctctgcacgtacggaaccngctagtgtagttggttggttagttaatacttagtcgtcctaccgtacgtaacccaacaaccgaccgacggaccaaccggaccccaaagtctaagtgtaatttagagtactgtacgtagtaggacggtccggtccgtacggtaccggggttcctaggtactccgtcttcgtccgtcggacctacgacgtccgacggtaccaacccgtaccgtccccttaacccgaaccttacgtcccgttcggtaccgggtcccgtacccggtagggtccgtagggacgtagttacgggtagtaccgtttaagtaacttttaccgttacgcgttacgttcgaccttagtaacgttcgtacggtccggtaacggtaccggttaaacggttcgtttaaccggtttcgggtaacgggtttaccggggaaccggggttaagtaacccggttacgggttaacccggacccggtttcggtaacgggtaccccgtaaaccggaccccgttaagggtccccgtttacccccggg

SEQ ID NO: 149826 - DNA, 736 bp, Homo sapiens
  misc_feature: GYAE6OF01A04G1.19.14.B03.1.454.CMB.1.raw
  modified_base (338)..(338): a, c, t, g, unknown or other
  misc_feature (338)..(338): n is a, c, g, or t
tcagtactctcgtgcacgaccggtgctcgatttagtgtgagtagttccggcgggggggggggtctcaggaggcagcactctcgggacgtctccaccatggcctgggctctgctcctcctcacgcctcctcactcagggcacaggactccgtgggctcagtctcgccctgactcagcctcactcagtgtccgggtctccgtggacagtcacgtccacctatcctcctgcctactacggaaccagcagtgtagttggttggttagttaataactatcgtctacctacgtaaccaacaaccaccgaggaccaaccggaccccaaagtcagttagtatttangtattcgtcgaagtcggacggtccggtcccgtacgggtaccgggttcctaggtaccgttccgtcgtttccgtcggtccggtccttaccgtaacggttccgtacgggaaccctaaccgacccggttacccccttaaccctaaccgtctttcccggtccggtaccgggtacccttacccggagggttccgttaagggacggtacgtcgggtacggtcttaaggttactttacttacgcgtcttcgaccttagtaacgttggtacgtacgtaccggtactaacgggttacttacggtttacgggtaccggttaggggtacccgggaaacggacccgtaagttcccgggtacggtaacccggttacgttacggtacccgacggaacccggtaccggtcccgg

SEQ ID NO: 149827 - DNA, 742 bp, Homo sapiens
  misc_feature: GYAE6OF01CS7BE.19.14.B03.1.454.CMB.1.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctggctcagtctgccctgactcagcctcactcagtgtccgggtctcctggacngtcagtcaccatctcctgcactggaaccagcagtgatgttggtagttatactatgtctctgtaccaacacaccagcacgacccaagtcatgtattangtatgtcagtgacgccgccctcggacggtccctgactcggtcttcgtcgtagtcctaccgtaacgtccgtacgggacccaaccgtacccgggtaccccttaccccgttaaaccgtcctttcccgttacccgttcggggtaccccttacccggtacgggtaccgtaagggtaacggtacgtaacgggtacggttaccgttaggtttaacgtttaacgtttaaccgttcggtaccgttcggtaccttacgttaagttacgtacggtaccgtacgggtaccgttaacgggttaaccgttacggttttaacgggttacggtttacccgggggaaccggggttaaccggggtaaacccggtaaccgggtacccggttaccggtaaacccccgggtttccggttaaaccgggtaccccgtaaacccggacccccgggttaacggttcccccccggg

SEQ ID NO: 149828 - DNA, 818 bp, Homo sapiens
  misc_feature: GYAE6OF01DMKLC.19.14.B03.1.454.CMB.1.raw
tcagtactctcgtgcacgaccggtgctcgatttagtgtgagtagttccggcggggggggtctcaggaggcagcactctcgggacgtctccaccatggcctgggctctgcctcctcctcacgccctcctcactcgaggggcacgaggactccgtgggctcagtctcgcctgactcacgcctcactcgtaggtcggtccgggtctccgtggacctagtcacgtaccacctctcctccgtcgtacacgtacggaaccgagacgtagtgtagttggtttaggttaagttaacttaacgtgttcgttccgttaccgtacggtaaacccaaaccgaaacccgtacccgaacggacccgaaacccggtacccccgtaaagttaccgtacgttaagtttaatttggtacggttaagttccgttaacggacgggttaaccgccgggtacccgggtccccggtacggggtaccgggttcctaggtaccccgtttccggtcccttccggtttccggtaccggtccctaacgtaacggttcccggtaaaccggacccgtaacccggtccccgttaacccctaaccccgtaaccgtccgtacccggtccgggtaccggtacccttaccggtaccggttagccgggtaagttaccgggtcgtaacgggttaccttagttaacgtttacgtcgttccggctagtaccttacgacgttgacgcgtaacggtcggttaacgttcgttaagggttacggtacggtaccgggacggtacgtaaccgtcgcgggttaacgaccccgtataccgggtcacccggtggaccccggtcccg

SEQ ID NO: 149829 - DNA, 620 bp, Homo sapiens
  misc_feature: GYAE6OF01BHH6R.19.14.B03.1.454.CMB.1.raw
  modified_base (464)..(464): a, c, t, g, unknown or other
  misc_feature (464)..(464): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatcctcctgcacgtggaaccagcagtgattggttggtaggttataactatgtctccgtgtaccaacaacaccaggacaacgaccccaagtcatgtattatgatgtacagtgacgccggcctacggacgggtcccaggtactcgtcttcgtcgtcgtcctaccgagtcgtcggacaaccgaccggtccctaccctaactctccgtcgtcggcctaccgacggtctagagtacgtggacgtcttaggtatttacgttacncgtactcggtacttacgtagtactcgacgacggtacgtacggtacgttacgtttagggtacggttaacgggccgggtaacgggtaaccgtacggtccgttaaccggtcccggttaccgtacgggtacctaacccggtaccccggaggtacccccgg

SEQ ID NO: 149830 - DNA, 720 bp, Homo sapiens
  misc_feature: GYAE6OF01CHWYK.19.14.B03.1.454.CMB.1.raw
tcagtactctcgtgcacgaccggtgctcgatttagtgtgagtagttccggcgggggggggtctcagggaggcagcactcgtcgggacgtctccaccatggcctgggctctgcctcctcctcacgcctcctcactcgagggcacgaggactccgtgggctcagtctcgccctgactcacgcctcactcgaggtcggtcccgggtctccgtggacagtcagtccactctctctgcacgaggaaccagctagtgagttggttaggtacgttaataactagttcgttcctacgtacggtaaccaaccaaccgaaccgacggaccgaaaccgacccaaagtctaatagtacttatagtagtcgtacgagtcgacggtccgtaccgtaggacgggttctgtacgtcgtcttacgtcgtacggacctacgtagtccgtaccgaacgtaacccgtaccggtaccccttaaccctaaccgtcttccggtaccgggtacggtaccgtaccggacggtacggtcgggaaacggtggtacggaacgttacgtatttaacgttacgtcgttacgcgttacgtacttacggtaatcggacggacgtaacggtacgttaaccggttagttacggtttacgggtacggtaccggggacgggtaccggtaacgtacggtcccgtacggtaacccggtacggtaacggacccgaaccgttacccgggacggttccccg

SEQ ID NO: 149831 - DNA, 697 bp, Homo sapiens
  misc_feature: GYAE6OF01DQKS4.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagccctcctcactcagggcacaggatcctgggctcagtctgccctgactcagcctcactcagtcggtccgggtctcctggacagtcagtccaccatctcctgcactggaaccagcagtgatggttggtggttaataactattcgtctcctacggtaaccaacaaccacccgaggaccaaccggaccccaaagtcatcgtattatgtatgtcagtggacgccggtccctcggacgggtcctgacgtcgtcttcgtcgtggtcctaccgtaacgtcgtacggacctaaccgaccggtcccttacccctaaactcgttcccttccggtcggggtaccctacccggagggttaccgtagggtacgggtaacttcggggacggttaccttagttaactttttacgttaccggttgccgttgtccttactaagttcgttacggacacgggtacgttaacgggttaaccgttacggtttcggggttacggttccgggggtaacgggacgggtaaccaaacgggttcccggttaccggacccggttccgttaaacgggcccgtaacccggcccgtaacggttccccgg

SEQ ID NO: 149832 - DNA, 733 bp, Homo sapiens
  misc_feature: GYAE6OF01DOA8D.19.14.B03.1.454.CMB.1.raw
tcagtactctcgtgcacgaccggtgctcgatttagtgtgagtagttccggcgggggggggtctcaggaggcagcactctcgggacgtctccaccatggcctgggctctgcctcctcctcagccctcctcactcagggccacaggatccgtgggcctcgagtctcgccctgactcagccctcactcgagtcgtccggtctccgtgactagtcacgtccacctatcctcctcgcacgtcggaaccagcagtgtagttggtggtagttactaactgtcgtcctaccgtacggaaccaacaaccgaccgcgaacgaaccccgtaacccaagtccagttaagtactttagtcgtattcggtactagggtccggtaccggacccgtaccccgggtcgtaccgggtaccttcggtacgttcgtccgtttcgccggtaaccgtacccgttaaccggtaacgttccggaaccgtacccgtaacccgtacccggtacccctaaccgttaccgtaccgttaccggtccgtacgggtaccctaccggtacgggtactagggtacgtcggtaagtccgttacgtactttaagttaccgtaccgttcgcgttccgacgttaagttcgtagacggacgtacgtaccggttaggttcttacgggtttacggacgggtaccggacgggaacggtaccacgggtaccgtaccggtacccgtagtacgacccgtccgacggtccccgtaccg

SEQ ID NO: 149833 - DNA, 708 bp, Homo sapiens
  misc_feature: GYAE6OF01CG0Y2.19.14.B03.1.454.CMB.1.raw
  modified_base (228)..(228): a, c, t, g, unknown or other
  misc_feature (228)..(228): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtccaccatctcctgcactggaaccngcagtgatggttggtgttataactatgtctctgtaccaacaacaccgagcaaccggaccccaagtcatgtatttatgtatgtcagtgacgccggtcctcggtacgggtcctgactcgtcttcgtcgtcggtcctacgtaagtccgtcggaccaaccgtacccggtaccccttaccctaacctacttcccgttccggtccgggtccctacccggaggtcgttagggacggtagtacgggtaggtcttaggttaattttacgttacgtcgttcgtcggtaccttacgtaagttacgtcggtaccggtaacgggtaccgttaaagggtttaccgttacgggtttttacgggttaacgggttaccggggggtaccggggtaaaccgggtaaacccgtaacgggttacccggttaaccggtaaccccggttaccgggttaaccgggtaccgtaacccggaaccccggtaaccggggtccccccgg

SEQ ID NO: 149834 - DNA, 715 bp, Homo sapiens
  misc_feature: GYAE6OF01DII2U.19.14.B03.1.454.CMB.1.raw
  modified_base (227)..(227): a, c, t, g, unknown or other
  misc_feature (227)..(227): n is a, c, g, or t
  modified_base (484)..(484): a, c, t, g, unknown or other
  misc_feature (484)..(484): n is a, c, g, or t
tcagtactctcgtgcacgaccggtgctcgatttagtgtgagtagttccggcgggggggggtctcaggaggcagcactctcgggacgtctccaccatggcctgggctctgcctcctcctcagccctcctcactcgagggcacgaggactccgtgggctcagtcctcgccctgactcacgccctcacgtcgaggtcgtccggtctccgtggacagtcacgtccaacctntccgtcctgaccacgtacgaaccgtagcgtaggtgtagttggttggttagttaactaagtagttcgtaccgttaccgtacgtaacccaaacaacccgaaccggtacggaacccgaaacccggaacccccgtaaagccgtaagtagttaacttagagtattgacgtagtcgacggccggtaccgtacggccggtctagtactccgttctcgtcgtcgtcctacgtagtcgtacgacctaccgcgtaccctaccgtacnccgtcgtcgcggcccttacggacgtcgaaggtgtacggtaggacggtcttaggttacttaacgtttgaccgtcgtcgtactagtacgtacgcgacggtacgtacgtacggttacgtttacggttcgggtaaccggttaccggggaccggtaaccggtacgtaaaccgttccggtaacccgtaaccggttccggtaacggtacccgaccccgtaacggtccggtacccccgg

SEQ ID NO: 149835 - DNA, 695 bp, Homo sapiens
  misc_feature: GYAE6OF01DPLDC.19.14.B03.1.454.CMB.1.raw
  modified_base (318)..(318): a, c, t, g, unknown or other
  misc_feature (318)..(318): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcacgtcaccatcctcctgcactcggaaccagcagtgagttggttggtgttataactagtcgtctccgtacggtaaccaacaacaccgagaccaacggaccccaagtcatgtatttangtatgtcagtgacggccgcctcgtacgggtcctgtactcgtcttctcgtgtcctcgtagtcgtcgacaaccgtaccggtccctacccgtaacctacgttccgtcgttcgggtccctccggtacgggtccgtagggacggtacgtaggtacggtcgttagttaagttttaacgtttcgtcggtacgttcggttaccttacgttaagttacgtacggacggtacgggtacgttaacgggttacctttacggtttcgggttaccggttaccgggggaacccgggtaaaccggggtaaccctagggtacccgttacgggtaaaccccgtttccgggttaacgggtacccgtaaccggaaccccggtacgggttccccccgg

SEQ ID NO: 149836 - DNA, 722 bp, Homo sapiens
  misc_feature: GYAE6OF01DQLAQ.19.14.B03.1.454.CMB.1.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (318)..(318): a, c, t, g, unknown or other
  misc_feature (318)..(318): n is a, c, g, or t
  modified_base (527)..(527): a, c, t, g, unknown or other
  misc_feature (527)..(527): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcgagggcacaggatccgtgggctcacgtctcgccctgactcagcctcactcagtcgtccgggtctccgtaggacagtcagtccacatctcctgctactacggaaccngcagtgattggtgtcgttatacgtatntctcgtagtaaccaacacaccgagacaaccgtacccaaagtcagtagtattacgngtatgtacgtagtggacgtccggtacccgtacggaccgggttccctagtacgtccgtcccttctccggtacggtaccttaccgtaacgttccggacggtaccgaaccgtacccgggttacccctaccctaaacctcgttccgtcgggtaccggtccgtaccgacgtcgtagggacgtacgtggtacgtcgtagttaatttacgttacgngttacgtcgtaccgttaactaacgtttccggtgacggtacggtacgttacgggtttaaccttacgggtttggttaaacccgggttccgggggaacggttaaacgggacccgtaaacggttcccgggtaaccgggtaccccgttaacgggtaaccggttacccgaacccggtcccggtaaccggttacccccccgg

SEQ ID NO: 149837 - DNA, 591 bp, Homo sapiens
  misc_feature: GYAE6OF01CZ82S.19.14.B03.1.454.CMB.1.raw
  modified_base (209)..(209): a, c, t, g, unknown or other
  misc_feature (209)..(209): n is a, c, g, or t
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
  modified_base (468)..(468): a, c, t, g, unknown or other
  misc_feature (468)..(468): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctctcactcagggcacaggatccgtgggctcagtctgccctgactcagcctcactcagtcgtccggtctccgtggacagtcagtcaccntctctgcactcggaaccagcagtgattgttggtagtttataactatgtctcctacgtaaccaacacaccgaggccaaccggaccccaaagtcatgtatttangacttgtcagtgacgccgcctcggcggtcctgactcgtcttctcgtacgctacgagtcgacgacaaccgccgtacctaccaacctcgtcctcgtacggccctcggacgtcgaggacgtgtaggcgtntacgttatttacgtcgtcgcttgcctacgnttacgcgcgacgtacgtcgttaacctttggtcgttaggggtccggaagggaaccggtaccgtacgtccggtaccggttacccgttcggtaaccgggttcaccgggtacccgtcggtacccccg

SEQ ID NO: 149838 - DNA, 689 bp, Homo sapiens
  misc_feature: GYAE6OF01DZ4CH.19.14.B03.1.454.CMB.1.raw
  modified_base (233)..(233): a, c, t, g, unknown or other
  misc_feature (233)..(233): n is a, c, g, or t
  modified_base (505)..(505): a, c, t, g, unknown or other
  misc_feature (505)..(505): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggactcctgggctcagtctgccctgactcagcctcactcgagtcggtccggtctccgtggacagtcagtccaccatcctcctgccactaggaacccngcagtgagtggttgtgttaataactagtcgtacctctacggtaaccaacaaccgaccgacggacctaaccggaccccctaaaggtccaagttcgtaagtttactggtaacttcgtacgtaggtgacggtccggtcccgtacgtacggggtccctaggtacttcgtctttccgtacgtcgtcctaccgtaagtcgaggaccaaccgacccgtacccttacccactaccgttccgtccgtcgggtaccctccggtacggtaccgttaggacggngttacggacggtcttagtaacttttaacgtctacgtctacggcttacgtatacgttcgacggaggttacacgttacgttcggtttacggtcgttaccgggggacgtaacgggactaccggtccgttaacgggacccccgtttacgggaccggttaccgaacccggcccggtaaggttccccccg

SEQ ID NO: 149839 - DNA, 726 bp, Homo sapiens
  misc_feature: GYAE6OF01BCNL9.19.14.B03.1.454.CMB.1.raw
  modified_base (443)..(443): a, c, t, g, unknown or other
  misc_feature (443)..(443): n is a, c, g, or t
tcagtactctcgtgcacgaccggtgctcgatttagtgtgagtagttccggcggggggggtctcgaggaggcagcactctcgggacgtctccaccatggcctgggctctgctcctctcagcctcctcactcgagggcacaggctccgtgggctcagtctcgcctgactcagcctcactctagtcgtccggtctccgtaggctacgtcacgtccacctacttccgtcctagcctacgtacggaaacctcgcagtgtacgttggttggtacgttaattaacgtgtcgttcgtaccgtacggtaaccaaccaacgaccgaggaaccaaccggtacccaaacgtcgtaagtacgtagttataggtactcggtacagtacggacgcccggtcctacggtccgggttcctagtctcgttacgtcgtagtccgtacgtaaccgtcgttacncggtaaccgaaccggtacctcccgtaacctaaccgtcgtaccgttcgggtaccgtccgtaccgtacggtacgtacggtaacggtcggtacggtaccggttctttaacggttatttacccgttagtcgtacgttcgtacttaccgtaagtacgtacgtaacgcggttacgtacgttaacgttacgggtttacggtaggtacccggggaacgttaacggaacgttacggttcggtaccgtaccgtttaccggaggtaacccgccgtaaccgggtcctaccccggg

SEQ ID NO: 149840 - DNA, 707 bp, Homo sapiens
  misc_feature: GYAE6OF01D50XH.19.14.B03.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagccctcctcactcgagggcacgaggatccgtgggctcagtctgccctgactcagcctcactcagttcggtccgggtctccgtggacagtcagtcaccntcctcctgcactggaaccngcagtgagttggttggtagttaatactatgtactcgtcggtaaccaacaaccaccaggtaccaaccggacccccaaagtccagttagtatttacgtgtactgtcgagtggacgcccgtaccgtcgtacgggtcctagtcgactcgtcttcgtcgtcggtacctccgtaacggttcgtacggaacctaacccgtacccggtccccttaaccctaaaccgtcttacccgtcgtcgggtaccctaccggacggtcgtacgggagtcgtaggacgttcgtaagtacttttacgtaccgtacggtccttacggcgttacctaagttagtccgtaacggtaccggttacgttaaccggttaccttacggttttacggggttaccggtccgggggtaagggtaacggtaccgtaaacgtcccggtaacccggtaccgtacccggttacggtaccccgacggtccccggttaacccggg

SEQ ID NO: 149841 - DNA, 803 bp, Homo sapiens
  misc_feature: GYAE6OF01DIDVN.19.14.B03.1.454.CMB.1.raw
  modified_base (143)..(143): a, c, t, g, unknown or other
  misc_feature (143)..(143): n is a, c, g, or t
tcagtactctcgtgcacgaccggtgctcgatttagtgtgagtagttccggcgggggggggtctcagggaggcagcactctcgggacgtctccaccatggcctgggctctgctcctcctcagcctcctcactcagggcacaggntccgtgggctcagtctcgccctgacctcagccctcactctacggtcgttccggggtctccgtggacctagtccacgtccacctatcccgtcctgaccacgtacggaacccagcgtaggtgtagttggtttgggtaggtttaactaaacttattcgtccttaccgtacggtaacccaaaccaaccgacccgacggaccaaaccggacccctaaagtccagttacgtaatttagagtagttcgtacgtaggtacgaccggtcccggtccccgtacgggtaccgggttcctaggtctccgttccttcctcggtcgccctacgtaagtcgtcggaaccaccggtacccggtccctacccgtaacctccgttaccgtccgggtcgtacccgtaccgtacgggtcgtacgggtacggtacgtacgggtaacggttcttaaggttaacctttaaggtttccctacgttccgtacgttaccttacgtacgttaagcggtaacgtacgggtaaccgttaaggttaacccggtttacggttttacggggaaccggtttcgggggggaacccggttaaaccggggaacccgttacgggtacccgtcgggttaacccccgtacgggttaaccggaccccggtaacccgggtacccgtaaccgggttcccccg

SEQ ID NO: 149842 - DNA, 657 bp, Homo sapiens
  misc_feature: GYAE6OF01EMO3O.19.14.B03.1.454.CMB.1.raw
  modified_base (300)..(300): a, c, t, g, unknown or other
  misc_feature (300)..(300): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtcgtccgggtctcctggacagtcagtcaccatcctcctgcactggaaccagcagtgatgttggtgttataactatgtctctgtaccaacacaccagcaacgaccccaagtcatagtatttangtatgtacaggtgacggtccgcccgtcggacgggtcctagacgtcgtcttcgtcgtcggtctaccgaagtccgtacggaccaaccgacccggtccccttaccctaaccacttccgtcgtcgggtaccctaccgacgggtccgtaggtacggagttacggacggtctagttaactttacgttacgtcggtctcgtaccttacgtattacggtcgaacgtacggtacgtacgggttaccttaacgggtttcgggttacggttccggggacgggtaacgggaacccgtaagggtcccgttacgggtaaccccggttccggtaacgggtaccccgaacggccccggtaacgggttcccccg

SEQ ID NO: 149843 - DNA, 729 bp, Homo sapiens
  misc_feature: GYAE6OF01A18DC.19.14.B03.1.454.CMB.1.raw
  modified_base (310)..(310): a, c, t, g, unknown or other
  misc_feature (310)..(310): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgagtgttggtagttataactatcgtctaccgtaggtaccaacaacacccgaggacaacggaccccaagtcatgatttangatgtcagtgacgcggcctcgacgggtcctgactcgtcttctcgtcggtctaccgaacgtcgtacggaccaaacgtacccggtcccctacccgtaaccacgttcccgtcgtcggggaccttacccgagggtccgtagggaagggaacgttacgggaacggtcccgttaaggtaaacttttaacgtttaaccgtcggtaaccgttcggtaccctttaacgtaactttaacggtacggtacggtaacggggtaccgttaaacgggttaacccgttaacggtttttacgggttaaccggttaaccgggggtacggggtaaaccggggtaacccgttaaacgggtcccttaaccgggtaaccccgggtttaccgtaacgggttaacccgaaccggtacccccggtaaaacgggttcccccggg

SEQ ID NO: 149844 - DNA, 687 bp, Homo sapiens
  misc_feature: GYAE6OF01ASSG3.19.14.B03.1.454.CMB.1.raw
  modified_base (235)..(235): a, c, t, g, unknown or other
  misc_feature (235)..(235): n is a, c, g, or t
  modified_base (577)..(577): a, c, t, g, unknown or other
  misc_feature (577)..(577): n is a, c, g, or t
  modified_base (674)..(674): a, c, t, g, unknown or other
  misc_feature (674)..(674): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggactccgtgggctcagtctgccctgactcagcctcactcagtcgtccgggtctccgtggacagtcacgtcaccatcctctgccacgtcggaaccngcaggtgattggttggttaggttaataacgtagtcgttcctccgtacggtaaccaaacctaaccaccccgaggaccgaaccggtaccccgaaagtcctaagtcgtaattttacgtgtagttagtacgtaggtgacgtccggcccgttcggaaccgggttccctaggcgttccgtcgtttcctcggtcggtcctactacggtcgtcggaacctaacccgaccggtccccttaaccctacctacgttccgttaccggtcggtaccctccggacggtctagggacggtacgtcggtaacggtctacggtttaatttaaccgtagttccggtactcgtacccttanaacggttatcgggacgtacggtacgtaacgtttcgttacggtttcggtaacggttccggggtacgaggaccgtacgtcgaccgtcgtaccgcgtacncgtacgtgtcccc

SEQ ID NO: 149845 - DNA, 723 bp, Homo sapiens
  misc_feature: GYAE6OF01A7C4S.19.14.B03.1.454.CMB.1.raw
  modified_base (229)..(229): a, c, t, g, unknown or other
  misc_feature (229)..(229): n is a, c, g, or t
  modified_base (678)..(678): a, c, t, g, unknown or other
  misc_feature (678)..(678): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcgaggcacgaggactccgtggctcacgtctcgccctagtactcacgtcctacactcaggttcggtcccggtctccgtaggactacgtcacgtccaacctntcctcgtcgaccgtacgtacggaacctagactagtgtagtggttaggttagttaactattagtcgtcctcgtacgtaaccaacaaccgaccgacggaccgaacccggtaccccaagtcagtacgttaatttgagtacgtacgtacgtaggtacggacggtcccggtacccgtacgggtaccgggtcctagtacgtccgtccttcgtccgtaccgtcctaaccggtacgttcgtacggaaccctaacccggtacccgtaccccttaacccgtaacctcgttacccgtccgggtaccgggttccccttacggaccgggttcgtaagggacggttagtcgggacggttccttaaggttactttaaccggttgtccgtgtaccgtactacgtaagtcgtcgacgtcgtaccgtagttaccgtttgttagggtacgtcgggacgtacgaccgtntaccggtaccgtaccgtacggactacccgacgtaccgcggtcccg

SEQ ID NO: 149846 - DNA, 738 bp, Homo sapiens
  misc_feature: GYAE6OF01EVN3V.19.14.B03.1.454.CMB.1.raw
  modified_base (190)..(190): a, c, t, g, unknown or other
  misc_feature (190)..(190): n is a, c, g, or t
  modified_base (293)..(293): a, c, t, g, unknown or other
  misc_feature (293)..(293): n is a, c, g, or t
  modified_base (559)..(559): a, c, t, g, unknown or other
  misc_feature (559)..(559): n is a, c, g, or t
  modified_base (586)..(586): a, c, t, g, unknown or other
  misc_feature (586)..(586): n is a, c, g, or t
tcagtactctcgtgcacgaccggtgctcgatttagtgtgagtagttccggcgggggggggtctcaggaggcagcactctcgggacgtctccaccatggcctgggctctgcctcctcctcacgccctcctcactcgagggcacgaggctccgtgggctctagtctcgccctagacctcacgcctcactacnggtcggtccggtctcgtaggactagtcagtccacctacttcctcctcgacacgtacggaaccagcgtaggtgtagttggttacgggttagttaactaacgttnttcgttcctccgtaacgtaaccaaaccaaccacccgacggaccaacccggtaacccctaagtctagttacgtttaatttagtaagtcgttgtacgtaaggtcggaccggtcccggtcccgtacgggtaccgggtcctagtcgtccgttcttcgtcgtcgtccacgtaagtccgacggacaaccggtccgtaccctaaccactcttccgtcgcggtctcgacggtcgtaggacgtagtggtcgtacgttagtaactttacgttacgngttcctgtaccttacgtagttaccggngtaacgtacggtaacggttaggttaccgtttaaggggtttacgggttaccggtaaccgggggtccggtaaacgggtaacctaccgggtccggttaaccggttaccccggtacggttacgggacccaaccgggtaccccgtgggtaccccccg

SEQ ID NO: 149847 - DNA, 791 bp, Homo sapiens
  misc_feature: GYAE6OF01BD6M7.19.14.B03.1.454.CMB.1.raw
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatcctgggctcagtctgccctgactcagcctcactcagttcggtccgggtctccgtggacagtcagtcaccatcctctgcacgtaggaaccagcagtgagtggttaggtagttaataactatgtcctccgtagtaaccaaacaaccaccgacggacaaccggacccaaagtcaattgtattacgtgtactgtacgtaggtgaccggtccggtcccgtacgggtaccgggtcctagtactccgtcttccgtcgtcggacctacggtaagtccgacggaccaaccggtacccggtacccctttaacccgaaccctgttcccgtaccggggtccggtacctcccggtaagggtcgttaaacgggaggtagtcggtaaccggttcgttaacgttattttaacgttccggtcgtaccgtttaccgacgttacgtaagttcgggtaacccgtaaggtaccggtacggtttaaacgggttacggtttaaaccggttttcggggttaaaccggggttccggggggaaacccgggtaacccgggggaaacgtacccggggtttaccccgggttaaccgggtacccccgggttttaaccggaccggggtttaaacccgaaccccggggttaaccccgggttaacccgggttccccccggg

SEQ ID NO: 149848 - DNA, 946 bp, Homo sapiens
  misc_feature: GYAE6OF01CQABA.19.14.B03.1.454.CMB.1.raw
  modified_base (180)..(180): a, c, t, g, unknown or other
  misc_feature (180)..(180): n is a, c, g, or t
  modified_base (255)..(255): a, c, t, g, unknown or other
  misc_feature (255)..(255): n is a, c, g, or t
tcagtactctcgtgcacgaccggtgctcgatttagtgtgagtagttccggcgggggggggtctcaggaggcagcactcgtcgggacgtctccaccatggcctgggctctgcctcctcctcacgcctcctcactcgagggcacgaggactccgtgggctcacgtctcgccctgactcgacncctcactcgtagtcggtccggtctccgtggactagtcagtccacctatcctcctagaccgtacgtacggaaaccncggtactaggttaggtaggtttggggtttagggtaagtttaactaacgttagttccgtaccgttaccgtaacggtaaacccaaaccaacccgaaccggtacggacccgaaacccggacccctaaaggtctaagttcgttaattttacgagtaacgttcgtacgtaggtacggaccggcccgtccgtacggtaccgggtcctaggactccggttcttccgtacgtccggtctaaccgtacggtcgacggtaaccctaacccggtaccccgttaccctaccccgttaaaccgtcccgtttacccggttaccgggtaccggtacccgttacccgggtaccggttacggttacgggaacgggttacgggtacgggaacgtttacggttaaatttaaccggtttaccgtttacgtacccgtttacggaccgttaacgtttaccggacgtttacggtacccgggaacgggtttaccggtaacggtttaaacccgggtttacgtttaaaccggggtttttacggggtacccggggtttaacccggggggtaaaaccggggtaacccggggttaaacccttaaccccggggggttacgttaaccccccggggtttaaaccgggtttaccccggtaaccgggttaaccccggggtaaaccccggtaacccccggggttaaccccgggttacccccccggg

SEQ ID NO: 149849 - DNA, 708 bp, Homo sapiens
  misc_feature: GYAE6OF01DJDSE.19.14.B03.1.454.CMB.1.raw
  modified_base (530)..(530): a, c, t, g, unknown or other
  misc_feature (530)..(530): n is a, c, g, or t
  modified_base (570)..(570): a, c, t, g, unknown or other
  misc_feature (570)..(570): n is a, c, g, or t
  modified_base (676)..(676): a, c, t, g, unknown or other
  misc_feature (676)..(676): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagccctcctcactcagggcacaggatcctgggctcagtctgccctgactcagccctcactcagtgtccggtctcctggacagtcagtccacatcctcctgcacgtgaaccagcagtgagtggttggtagttataactatgtctcctacgtaaccaacaaccaccaggcaccgaccccaagtcatcgtattcgtagtatgtactaggtcgacggtccgtcccgtcggaaccgggttcctggtacttccggtctttcgtacgtacggtcctaccgtaacgtcgtacggaaccaaccggtaccgaacccccttacctaaaaccctctttacccggtcggttccgggaaccttccccgtagggtaccttagggacgggtgttacggacgggtccttagtaacgttttaacgttcgnggtaccctgtaccttactaagtcgtagcccgtaacgggtnttaaccggtaccgtttaggtttaggggaacgttccggggttaaacgggaccgtaacgggtaaaccggttcccgtaccgggttacccccggttagtaaccccgggtnaacccccgggtagacccggggttaaccccccg

SEQ ID NO: 149850 - DNA, 874 bp, Homo sapiens
  misc_feature: GYAE6OF01BVEF2.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcgagggcacaggatccgtgggctcagtctgccctgactcagcctcactcagtgtccgggtctccgtggacagtcagtccaccattctcctgcacgtaggaaccagcgagtggtagttgggtttggtaggtttaattaaacgttattcgttccttccgttacggttaacccaaaccaaacccgtaacccgaccggaacccgaaaccggaacccccccgaaaaggttaccaacgttaggttaacttttaagtacggtaacgttcgtacgtaaggtcggaacggtccccgggacccccttcgggtaacccggggttcctacggtaccgttccggtcctttccgtcgttcggtacctacccgtaacggttcccggtacgaaccccgaaccggtacccggtccccgttaccccgtacgtaaaccttaccgttcccggttaaccggttccgggtacccgttaccggacggttaccggtacgggaacgggtaaccgggtacggtacgttacggttaacctttaacccgttcgttgtccgtactacctacgttaagttaccgtaccgggttaggtaacgggtttaccttccgtttaaccgtttcgtttaccggttccgggtttaaccgttaacccggggttaaaccgggtaccgggtaaccggtttaaacccggtaccccggtttaaccccggtacggttacgggttaacccccgaacccgggtaaacccccggtaaacccggtaaaccccccg

SEQ ID NO: 149851 - DNA, 683 bp, Homo sapiens
  misc_feature: GYAE6OF01BG6XW.19.14.B03.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatccgtggctcagtctgccctgactcagcctcactcagtgtccgggtctccgtggacagtcagtccaccatctcctncactggaaccngcagtgatggttggtaggttataactatcgtcctcttacggtaaccaaacaaccacccgaggaccaaccggacccccaaaagtccaatgtatttagtagatagtcagtggacgccggtccctcggaccgggtccctggactcgtcttcgtcgtcggcctcaacggtcgtacggaccaaccgacccggtaccccttacccctaaacctcgttccgttcgtacgggtccctacccggaggtcgtaggaggtacgtcgggacggtcttacggtaatttcgttacgtcgtacgttcgtaccttacgtaagttcgtacgaccgtagggtacctacggttacgttacggttttagggtaccggtttacggggacggggttaaccggtaacggtaacggttcccggtaacccggttccggtacggtaccgaccgggaccgtaccggtcccggtacccccgg

SEQ ID NO: 149852 - DNA, 855 bp, Homo sapiens
  misc_feature: GYAE6OF01EHWVW.19.14.B03.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtgagtagttccggcgggggggggtctcaggaggcagcactcgtcgggacgtctccaccatggcctgggctctgctcctcctcacgcctcctcactcgagggcacgaggactccgtggctcacgtctcgccctagacctcacgtcctacactcgagttcggtccggtctccgtaggactcgtcacgtaccactactcctcgacgaccgtacgacgaacngacgtaggtgtagttggttaggttacgttaactacgtcgttcgttaccgtaccgtaacgtaaaccaaacgtaaccgaccggacgtaaccgaaacccgaaccctaagtacgttaattagttaactttagacgtcgttacgacgtagggtaccgtaccgtccccgggttaccgtaaccgggtccgggtaccttagtccgttcgttccgttacgtcggtacgtaccgtacgtaacgtcggaaccgtaaccacccggtaccttaccctaacccgttacgtaccggtttcggtaacccgggtcccgtaccgttaacgggccggttaaacggtacggggtaacgttacgggtaaccgggtccctttaagggttttaaacgtttaaccttttaccgggtttacggtcccgttaacggttacccggtttaacttagtaaaccgttggtaccgggtaagtaaccgggttaacccgttcgttaaagggttttcggtaaaccgggttccggggaacggggtacggtaaaccgtttaagggccccgttcggaaccggttaacccgtcgggttaccgaaccccgttaacggggtacctacccggttcccccgg

SEQ ID NO: 149853 - DNA, 700 bp, Homo sapiens
  misc_feature: GYAE6OF01BUSIL.19.14.B03.1.454.CMB.1.raw
  modified_base (200)..(200): a, c, t, g, unknown or other
  misc_feature (200)..(200): n is a, c, g, or t
  modified_base (502)..(502): a, c, t, g, unknown or other
  misc_feature (502)..(502): n is a, c, g, or t
  modified_base (539)..(539): a, c, t, g, unknown or other
  misc_feature (539)..(539): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatccgtgggctcagtctcgccctgactcacgcctcactcagtgtccggtctccgtggacngtcagtcacatctcctgcactacggaaccagcagtagtagttggttggttagttaataacgttattcgttcctccgttacggtaacccaaacctaaccgacccgaacggaccgaaaccggacccctaaagtctagtgtaacttttagtgtattgactagtcggacgtccgcccgtacggcggtcctgcgttcgtctctcgtcgtcctacgtacgtcgacgtaccaccgtacccgtacccttaccctaacgtcgtccgttccggtcgggtccctacccgcgggttactacgggaaccgggttntacgggtagttacctagttactttacgttcttacggngttcgacttacgtactagtcggaacgcggttacgtacgttccgtttaaggtttggtaaaccgggtcggggaacggtaacgggtaccctacgggttaccgtccgggttaaccgttacccgggtaacggtacccgtaaccgggaaccccgtaccggtcccccg

SEQ ID NO: 149854 - DNA, 817 bp, Homo sapiens
  misc_feature: GYAE6OF01AP730.19.14.B03.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggatccgtgggctcagtctcgccctgactcagccctcactcgagtcggtccgggtctccgtggacagtcagtccacctatctcctagcacgtacggaaccngcgtagtgattgggttaggttaggttaattaacgttattgttaccttcccgtacggtaaacccaaaccaaacccacccggaacggacccgaaaccgggtaaccccccgtaaaaggtcctaagttacgtaagttttactaggtaattcggttaacgaggttacggaccggtcccggtcccgtaccgggacggggttcccctaggtaccgttcgttaccgtttcctcggttacggtacccttaccgaagttcccgtaacgggtaacccaaccccggtacccggttacccccttaaccctaacccgtacggtttcccgtaccgggtccggttccccgtaccgtacgggtccgtaacgggtaaggtacggttcggtaacggttacttaggttaacttacgttacgtccgtctacgtactaacgtacgttacgtacgacggtaaccgtacggtaacccggtttatttaacggttttcggggtaccgttaacggggcccggggtaaacgttaccgggaccggttccgtaacccggtacggtaaccgttacgggaccgacccggcccggttaacggtcccccgg

SEQ ID NO: 149855 - DNA, 687 bp, Homo sapiens
  misc_feature: GYAE6OF01B96NF.19.14.B03.1.454.CMB.1.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (511)..(511): a, c, t, g, unknown or other
  misc_feature (511)..(511): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagccctcctcactcgagggccacgaggactccgtgggctcgagtctcgccctgactcacgcctcactcgagtcggtccgggtctaccgtggactacgtcacgtccaccatccgttctgccacgtcggaaaccngcagtnagttcgttggtacgtaataactntgtcctccgtacgaaccacaaccaccaggccaaccgcccaaatcatntattangtatcgagtgtcgcgacgccgtggacggtccagctcgtcttctcgtcgtcctacgagtcgagacctaacgacccgtccctaccctaactaccgttccgtccggacggtacctccgtacggtcgtacggacggtacggagttcgtaacgtaccgttacgtcgtcgtcgtgtacctaacngttacgtacgtacggttacgtccgttacgttccttagtttccgtaccgggttcgtttaacccgggtacgggttaccgggaaacccggtaccgggtttaccccgaccggtttacccggacggttaccccggaaaccccggaaaccctaaccccggggtaacccccttaaaccccggg

SEQ ID NO: 149856 - DNA, 652 bp, Homo sapiens
  misc_feature: GYAE6OF01CGZ64.19.14.B03.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (506)..(506): a, c, t, g, unknown or other
  misc_feature (506)..(506): n is a, c, g, or t
  modified_base (535)..(535): a, c, t, g, unknown or other
  misc_feature (535)..(535): n is a, c, g, or t
tcagtactctcgtgcacgaccggtgctcgatttagtgtgagtagttccggcgggggggggtctcaggaggcagcactctcgggacgtctccaccatggcctgggctctgctcctcctcacgcctcctcactcagggcacaggatcctgggctcagtctgccctgactcagcctcactcagtcgtccgggtctaccgtggacngtcagtcaccatcctcctgcactggaaccagcagtnagtgttaggtagttataactatcgtctccgtacggtaaccaacaaccgaccaggtaccaaccgggaccccctaaaggtccattagtaacttttagacgtactggtacctaggttacgggacggtcccggtaccctacggtaccggggttccctaggttaacgtccggtcctttctccggtcgtcccgtacctaagtccgacggtaacaccgaccggtcccctaacccgactacgttcctacgtcgggtcctacggagtcgtagaagtntggaagtctagttattacgtactgacgtntcctagacgttatggaccgtagcgtaacggtactacgtttggtacgtaccgggcggaggtaacctggtaccgtaccggacgttaacccgtagggactaccgacccggtcgtaccccg

SEQ ID NO: 149857 - DNA, 714 bp, Homo sapiens
  misc_feature: GYAE6OF01DXYII.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtcgtccgggtctccgtggacagtcagtccacctatcctcctgccactacggaaccagcagtgagtgttggtagttataactatacgttcctcctacggtaaccaaccaaccaccccaggaccaacggacccccaaagtccatagtatttactagactacgtctagtcggaacggtcccggtaccccgtcggtacggggtcccctaggtacttccgtccttcgtcgtcggtcctaccgtaacggtccgtacggaccgtaaaccgtacccgggtacccttaccccgttaaacctacgtttcccgtaccgttcggggacctacccggtacggaccgtagggaacggtagtacgggtacggtacgttaggttaactttacgttaacgtacgtcgttacggtacttacacttacgtcgacgtaccgggagtaaccggttaacgtacggttttaggtaccggttcggggacgggtaacgggacccgtaacgtacggtaccgtacccggtacgttacggccgaaccgtcccgaaggtcccccgg

SEQ ID NO: 149858 - DNA, 745 bp, Homo sapiens
  misc_feature: GYAE6OF01D3ROZ.19.14.B03.1.454.CMB.1.raw
  modified_base (147)..(147): a, c, t, g, unknown or other
  misc_feature (147)..(147): n is a, c, g, or t
  modified_base (229)..(229): a, c, t, g, unknown or other
  misc_feature (229)..(229): n is a, c, g, or t
tcagtactctcgtgcacgaccggtgctcgatttagtgtgagtagttccggcgggggggggtctcaggaggcagcactcgtcgggacgtctccaccatggcctgggctctgctccctcctcacgcctcctcactcgagggccacaggntccgtggctcagtctcgccctgactcacgcctcactcgagtcggtccggtctccgtggacagtcacgtccacctactcctcngactacgtacggaaccagcgtagtgtagtgggtttggtagttataacgtctcgtccgtacgtacgtaaccaaacaacgaccgacgacgaaccgaccctaagctatagtacttagtacgagtgtactgtacgcggtacccgtccgtcggtaccgggtctcgtacttcgtacgttcgtacggtcgacccgtagtacggtcgtaccggaactacccggtaccgtaccctaaccccgtacgttacgtccgttccggaccgggttccgtaccgacgggtaacgttacgggaacgggttcgtacgggtacgggtttactaccgtttaagttttaccggttacgtcgttaaccgtcgttaaccgtaacttacggtacgtccgggaacgtacggtaacggttaccggttacgtttcgggtttaacggtaccgggtaccggggaaccgggttaagacccggtacgttaccggtaccgtaccgggttaccgaacgggtccgacccggaaactccggggttaacccg

SEQ ID NO: 149859 - DNA, 765 bp, Homo sapiens
  misc_feature: GYAE6OF01B3DRK.19.14.B03.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (334)..(334): a, c, t, g, unknown or other
  misc_feature (334)..(334): n is a, c, g, or t
tcagtactctcgtgcacgaccggtgctcgatttagtgtgagtagttccggcgggggggggggtctcaggaggcagcactctcgggacgtctccaccatggcctgggctctgctcctcctcagcctcctcactcgagggcacgaggatccgtggctcagtcgtcgccctgactcagcctcactcaggtcggtccggtctccgtggacngtcagtccactactctcngcacgtacggaaccagcagtgtagttgttggttagttaataactgttcgtcctcgtaacgtaccaaacacgaccgaggaccaaccgacccaaagtcattagtatttagngtatgtacagtacggcgtaccggtccgtacgggtacggtcctaggtccgtccgttcgttccgtacgtccggtaccttacgtacgtcgacggtaaccgtaacccggtacctacccccgttacctaaccgtcgttaccgtccgtcggtaccctcgacgggcgttacggaggtacgggtacgtacgggtacgttaatttaattaccgtttacgtaccgtgtttccgtacttacgtaacgtttcggacggtaacgtaccggggttaacgttaacggttaccggtttaaacgggtttccgggttaacggggttacccggggtaacgggttacccggggaaacggttacccggttaccggttaccccgggttacccgggtttaaccgggtaccgggtaccgggtaaacccggtcccgggttaaacggtccccccggg

SEQ ID NO: 149860 - DNA, 768 bp, Homo sapiens
  misc_feature: GYAE6OF01AHIK8.19.14.B03.1.454.CMB.1.raw
  modified_base (211)..(211): a, c, t, g, unknown or other
  misc_feature (211)..(211): n is a, c, g, or t
  modified_base (420)..(420): a, c, t, g, unknown or other
  misc_feature (420)..(420): n is a, c, g, or t
  modified_base (694)..(694): a, c, t, g, unknown or other
  misc_feature (694)..(694): n is a, c, g, or t
tcagtactctcgtgcacgaccggtgctcgatttagtgtgagtagttccggcgggggggggtctcaggaggcagcactcgtcgggacgtctccaccatggcctgggctctgcctcctcctcacgcctcctcactcgagggcacaggactccgtggctctagtctcgcctgactcacgcctcactcgtaggtcggtccggttctccgtggacncgtcacgtccactcgtccttccgcgctacgtacggaaccaggtcaggttagtagtttcgggtttaggttacggttacttaacgttgttcgttcccgtaccgtaaccggtaaccaaccgaaccgaccggtaccggacccggtaaaccccgaaccccgtaaaggtttctaacggttaccgttagtttaacgtacgttactcggttaacggngtacgtaccgggtcccggccgtaccgggtacggtcctaggtactccgtcttccgtacggtcgtacctacggtacgtcgaacccgactaccggtccctccgttaccacgtacgtcctcggtagccgtacgcggtacgcggacgtcgtacgcggttacacgttattacccgtcgtacgtaagtccgtactcgtaagtcgtaggaccgtttacgacgggttaccgttacggtggtttacccgggtacgggttaaccggtaacggaggggttaccccncgttaaccggtccgggtaaccccgggttacacccggggttacccggacgttaccccgggtacgttccccccggg

SEQ ID NO: 149861 - DNA, 868 bp, Homo sapiens
  misc_feature: GYAE6OF01E5HR7.19.14.B03.1.454.CMB.1.raw
  modified_base (238)..(238): a, c, t, g, unknown or other
  misc_feature (238)..(238): n is a, c, g, or t
  modified_base (674)..(674): a, c, t, g, unknown or other
  misc_feature (674)..(674): n is a, c, g, or t
  modified_base (715)..(715): a, c, t, g, unknown or other
  misc_feature (715)..(715): n is a, c, g, or t
tcagtactctcgtgcacgaccggtgctcgatttagtgtgagtagttccggcggggggggtctcaggaggcagcactctcgggacgtctccaccatggcctgggctctgcctcctcctcacgccctcctcactcgagggcacgaggactccgtggctcgagtctcgccctgtacctcacgtccctcacgtcgtacggttcggtccggtctcgtacgacctgtcacgtctacctactccncgtcgacacgtacggaaccgagtcgtagtaggtagtttgggtttaggttaacggttaaactaacgtttacgttccggttaccctacccggtaaccgaaaacccaaacccgtaaacccgaccccggaaccggaacccgaaacccccgtaaccccgtaaagtacgttagttacggttaaatttagacgtttaaacggtcgtacgtacgggtacccggtaccccggttccggtcccgggtaccgggttaccgggttccttacggtcccgttcccgtttaacgttcccgtcgggtacccttacccggttaaacggaacgtttaccgggaacccctaaccggtaacccccgttaccccgttaacccccgttaacccttaacgtccccgttccggttccggggacctcccgggttaacggtaacgggtcggtaggtaacggngggtaggtaccgttacttaaagtttaccgtacgttttccgngttcccgtattaccgaacggtgttacggaacgtcgttaaccgtggttaacgttcgttacggggtaacgtcccgggaaacgtcgggaacgttaactccggtccgttaaccggtcccggagtacccgaccttacccgggacgcccccgttcccgg

SEQ ID NO: 149862 - DNA, 759 bp, Homo sapiens
  misc_feature: GYAE6OF01CU3GU.19.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagtactctcgtgcacgaccggtgctcgatttagtgtgagtagttccggcggggggggggtctcaggaggcagcactctcgggacgtctccaccatggcctgggctctgcctcctcctcagcctcctcactcgagggcacaggactccgtgggctcagtctcgccctgactcgacgcctcactcgaggtcggtccgggtctaccgtggacngtcagtccacctactcctctagccacgtacggaaaccngcgtaggtgagttggttggtaggttaacttaacttacgtctccgttaacgtaaccaaaccaaccgaaccgacgaccgaaccggacccctaaagtactaagtcgttaatttatgtagtcgtagagtacggacgccggtaccgtacggtaccgggtcctagtacgttcgtctttccgcgttacggtcctaccgtaacgtcgtacggaacccgaaccgtacccggtacccctaaccgtaaaccctcgttacctaccggttcgggaccctacggtcggtacgtaagggaacggtaggttacggacggttccgtagttaactttacgttaacgtcgaccgttacgtcctaaggttaacgttacggacgacggtacggtaccggtaacggtttaccgttaaggtttccgggacgggtttaccgggaacgggaaccggtacgtaccggtccgttaccggtaaccggtaccgtaaccggacccgtaaccggcccgtaacgggttccccgaccccggg

SEQ ID NO: 149863 - DNA, 890 bp, Homo sapiens
  misc_feature: GYAE6OF01EFUYR.19.14.B03.1.454.CMB.1.raw
  modified_base (273)..(273): a, c, t, g, unknown or other
  misc_feature (273)..(273): n is a, c, g, or t
  modified_base (727)..(727): a, c, t, g, unknown or other
  misc_feature (727)..(727): n is a, c, g, or t
tcagtactctcgtgcacgaccggtgctcgatttagtgtgagtagttccggcggggggggtctcaggaggcagcactcgtcgggacgtctccaccgatcggcctgggcctctgctcctcctcagcctcctcactcagggccacgaggactccgtggctctagtctcgaccctgtacctcacgcccttacacctcgtacggttcggttcccgggtctccgtaggaacctagtccaacgtccacctgtcctaccgtcgacctacgtacggaacccngtcgtagttgtagttggttttaggggttactttaacgttaaactgtttaccgttccgttaccgtaacggtaaaccccaaacgaacccgaccggaacgtacccgaaaccccgtaaccccgtaaagtcgttaacgttacggttaaacttttggtaacggtacgttacgtaaccgttagggtacggacccggaccccggttccccgtaacgggtccccggtttaccggacgttaccgtcccgtttcccgttaccggtaccggtaccggttacccttaacggtaacccgtttcggaacccggtaaaccccgtaaacccgtacccccggttacccctttaacccgtaacgttcccggttccccgtttacgggaccgggtttcccaacccgggaagggttccgtaagggtaaacggtcggtacggtaaccgtagttttacttaagtttacgtttaccggntttaccgactaccttaagagttcgaacgttcgggaactaaccgggttaacttcgttacgggttaccgtaaacgggtcgggaaacccggtggaacttccgcgtttaaaccccggccggttaacgacccgttacccgaaacccgggttccgaaccggttcccccg

SEQ ID NO: 149864 - DNA, 689 bp, Homo sapiens
  misc_feature: GYAE6OF01CF3IW.19.14.B03.1.454.CMB.1.raw
  modified_base (178)..(178): a, c, t, g, unknown or other
  misc_feature (178)..(178): n is a, c, g, or t
  modified_base (356)..(356): a, c, t, g, unknown or other
  misc_feature (356)..(356): n is a, c, g, or t
  modified_base (543)..(543): a, c, t, g, unknown or other
  misc_feature (543)..(543): n is a, c, g, or t
tcagtactctcgtgcacgaccggtgctcgatttagtgtgagtagttccggcggggggggtctcaggaggcagcactctcgggacgtctccaccatggcctgggctctgctcctcctcagccctcctcactcagggcacaggatccgtgggctcagtctgccctgactcagcctcactnaggtcggtcccgggtctcctgggactacgtcagtccaccatcctctgcactggaaccagtcaggtcgattggttacggtagttaactaactagttcgtcgtacctacggttaaccaaaccaaccgacccgaggtacccgaacggaccccccgtaaaggtacctagtacgtaatttagngtactgtcagtgacgtcccgccgtacgtcgggccctgaccttcgtccttacgtcgtacggtcctacgtacgtcgtacggaacacccgtaccgcccttaacccacgtacttccgtacgtcggtacctaccgcggtacgtaggagtacgtacggtacggtacctaagttacgttttacgaccggtttancgtaccgtcttacgtagttaacgccgtaacggaaccggtgtaacgttaccgttagggttacgtacggttccgggaacggtacgaaccgtagtccggttaccggacccgttaccgtaacggccgaacccggtcccgagttcccccgg

SEQ ID NO: 149865 - DNA, 653 bp, Homo sapiens
  misc_feature: GYAE6OF01BDO2E.19.14.B03.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (510)..(510): a, c, t, g, unknown or other
  misc_feature (510)..(510): n is a, c, g, or t
tcagtactctcgtgcacgaccggtgctcgatttagtgtgagtagttccgcggggggggtctcaggaggcagcactctcgggacgtctccaccagtggcctgggctctgctcctcctcagcctcctcactcagggcacaggatccgtgggctcagtctgccctgactcagcctcactcagtcgtccggtctccgtggacagtcagtcacntcctctcgcacgtggaaccagtctagtgattcggttggtgttataactntcgtcctcgtagtaaccaacaccaccgagaccaaccgaccccaagtcatacgtatttagngatgtacagtcgacgccggcctggaccggttccngtacctcgtaccttctccgtacggtcctacggtacgcgtacggaccaaccgcccgtaccctacctaacgtcgttccgtacggttccggcctaccgaggtcgtaggaacggtcagggtcgactttacggtatttaaaccgttgccttacggcttaccgngtaacttcggtacgcgtataccgggtacgttacgttcggtttaccggtacggttcgggacccgggttaggaaacgtcccgttgggaccgttaacccgtttcggaacggttacgaaccccggttaaccggccgttacccccggg

SEQ ID NO: 149866 - DNA, 823 bp, Homo sapiens
  misc_feature: GYAE6OF01BDQHP.19.14.B03.1.454.CMB.1.raw
tcagtactctcgtgcacgaccggtgctcgatttagtgtgagtagttccggcgggggggggtctcaggaggcagcactctcgggacgtctccaccatggcctgggcttctgctcctcctcacgccctcctccactcgagggcacgaggactccgtgggctcagtcctcgcccctgacctcacgcctcgactcgaggttcggtcccggtctcgtagactagtacacgtccacctactcctccgtgacctacgtacggaacccagctagtcgtagttggttagtagttaataactgtcgtcctcgtacgtaaccaacacaccgaggaccaaccggaccctaagtctagtagttacttagtatagtcgtacgagtacggaccggtcccggtaccgttaccgggtacgggttccctaggttaccttcccgtcgttaccgtcggtccggtaccttacggtacgttccggaaccggtaacctaaccccggtacccgttaccccttaaccgttacctaccgttccggtaccggtaccggtaccccgtagtacgggtacgttacggaggtacgtacggtacgttacgtttaagtaacggttttctacgttaccgtcgtcccgaagttaccgtagtacgggtactaaccggaggtttacccgtaacggttttaaccggtcggggttttaaccggaccggggttaaacccggggttacggggtaaacccgtaccgggtaccggtttaacccgggaaccccggttttaacccgcccggggtttaaccgaaaccccggtccccgggttaaacccggccccgggtttacccccccgg

SEQ ID NO: 149867 - DNA, 704 bp, Homo sapiens
  misc_feature: GYAE6OF01BAV25.19.14.B03.1.454.CMB.1.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcaggcacaggatcctgggctcagtctgccctgactcagcctcactcagtcgtccgggtctccgtggacagtcagtcaccatcctcctgcacgtcggaaccagcagtgattggttggtagtataactntgtctctagtaccaacacaccagccaacgccccaagtcatgatttagngattcgtacgtagtcgacggtaccgcccgtcggaccgggttccctaggtacgtccgtccttccgtcgttcggtcctaccgtaacggttccgtacggaccctaaaccgacccggttacccctaccccgtaacctcttaccgttccgtcgggtccctacccggacgggtcgtaggtaacggtagtacgggtaaggtcttaaggtaacttttacgttacgtccgtcgttaccgcttaccgttaattcggtaccgacgaccgggtaccgtaacggttaccgttaacgggttttacggttaccggtacgggtaccggggtaacgggaacccgttaaggtacccggttacccggtaacccgttcccggttaaggtacccgaacccggtcccgtaacgggtcccccg

SEQ ID NO: 149868 - DNA, 737 bp, Homo sapiens
  misc_feature: GYAE6OF01C0BSJ.19.14.B03.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagtactctcgtgcacgaccggtgctcgatttagtgtgagtagttccggcgggggggggtctcaggaggcagcactctcgggacgtctccaccatggcctgggctctgctcctcctcagccctcctcactcagggcacgaggatcctgggctcagtctgccctgactcagcctcactcagtgtccgggtctccgtggacagtcagtcaccatctcctgcactggaaccngcagtgatgttggagttataactatcgtctctgtaaccaacaacaccagcaacgacccaagtcatgtattagagtntgtcgagtgacggtccggaccgtcggacgggtaccctgtacgtcgtcgttccgtccgtcggtcctaccgtaacgtcgttacggaccgaaccgtacccggtaccctaccccgtaaaccctaccgttcccgttacgtaccgggtaccctcccggtacggtaccgtagggtacgggtagtacgggtacgggttaccgttaacgttaacgttttacttaaccggttcggtacgtttcgttaccttaacgtaacgttacgttcgtaccgtacgggtaccggttaacggttaaccgtttaaccggtttacggggttaaccgttaccggggtacgggtaaccgggtaacccggtaacgggtacccggttaaacggtaccccggttaacccggttaccggttaccggaaacccggtaccccggtacggtaccccccggg

SEQ ID NO: 149869 - DNA, 777 bp, Homo sapiens
  misc_feature: GYAE6OF01DDHSD.19.14.B03.1.454.CMB.1.raw
  modified_base (245)..(245): a, c, t, g, unknown or other
  misc_feature (245)..(245): n is a, c, g, or t
  modified_base (528)..(528): a, c, t, g, unknown or other
  misc_feature (528)..(528): n is a, c, g, or t
  modified_base (596)..(596): a, c, t, g, unknown or other
  misc_feature (596)..(596): n is a, c, g, or t
  modified_base (733)..(733): a, c, t, g, unknown or other
  misc_feature (733)..(733): n is a, c, g, or t
tcagtactctcgtgcacgaccggtgctcgatttagtgtgagtagttccggcgggggggggtctcaggaggcagcactctcgggacgtctccaccatggcctgggctctgcttcctcctcagcctcctcactcagggcacaggatccgtgggctcagttctcgccctgactcacgcctcactgagtcgtccgggtctccgtggacagtcacgtccacctatccgtccgtgacctacgtcggaaccnggacagtgagttggttggatttaataacgttatttccgtcgtacgtaacctaacaccaccgagacgaccgaccccaagtccatagtattttagacgtagttcgtacgtaggtacgacggtccccggacccgtggtaccgggtcccttagtaccttcggtctttaccgttcgtcgtccgtaccgtacggttcgtcgggaacccaccgtaccggtacccttacccgaacgtacgttccgtaccggttcggtaccccttacgacgggttaccgtaagggtaacggnggttacggcgttagtagtttaacgtttaccttacggtacgtccttcggtaccctagtaacgttaccgngtaaccggtgtaaccggttagttaacccgtttaccggtttagggtaccgttaccgggggggaaccggtaaaaccggtcgttaaccccgggtaagttaacccccgggtttaacccgttcggggtaaaccgttaccccncccgggttaaaaccccgcccgggttccccgttaaccccccgggg

SEQ ID NO: 149870 - DNA, 813 bp, Homo sapiens
  misc_feature: GYAE6OF01CH4L0.19.14.B03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
tcagtactctcgtgcacgaccggtgctcgatttagtgtgagtagttccggcggggggggggtctcagggaggcagcactctcgggacgtctccaccatggcctgggctctgctcctcctcagcctcctcactcgacgggcacaggactccgtgggctcgacgtcgtcgcccgtagaccgtcacgcctcactcgagtcggtccgggttctccgtggacnctcgcgtaccacctnttcctcctgacacgtacggaaccngtctaggtcgtaggttggttacgggtggtttaacttaacttagttcggtaccttaccgttaccggtaacccaaaccgaacctaccccggaacggaccggaaacccggtaacccccgtaagtaccgtaggttacgttaatttaacgtggtaacgttcggtactagggtcgtaaccgggtcccgtaccggttacggaccggggttaccctcggttaaccgttcccggttcttccgtcgtaccgggtacctaacgtaacggttcgacggtacgtaaccgccggtacccctacgtaacctcgttaccgtcggtccgaccgtacgtcggtacgtaggagtaggtcgtacggtcttaacgttaacttgtaccgtgtacctagttacctagtacttacggtcgaccggtcggtaacggttccgttaacgtttacgggtcgggtttaacccgggacggggggtttacggaacccgggttacggtaacgtaccccgggttaccggaccggtttaacccggtaaccggttacccgaccccgggaccgtcccggggttacccccggg

SEQ ID NO: 149871 - DNA, 760 bp, Homo sapiens
  misc_feature: GYAE6OF01A7CCG.19.14.B03.1.454.CMB.1.raw
  modified_base (357)..(357): a, c, t, g, unknown or other
  misc_feature (357)..(357): n is a, c, g, or t
tcagtactctcgtgcacgaccggtgctcgatttagtgtgagtagttccggcggggggggtctcaggaggcagcactctcgggacgtctccaccatggcctgggctctgctcctcctcagcctcctcactcagggcacaggatccgtgggctcagtctgccctgactcacgcctcactcgagtcggtccgggtctccgtaggacagtcagtccacctatccgtcctgccacgtacggaaccacgcgagtcgtagttggttaggttaggttaactaacgtagttcgtcctcgtacggtaaccaaacgaaccaccgacggaccaacccggacccctaaagtcaacgttgtaactttacgngtacgtcgtacgtagtcggacggtcccggtaccgtacgggtaccgggttcctagtaccgttccgtcttccgtcgttccgtaccgtaccgtaacggttccgtacggacccgtaaacccggtcccgtaccccttacccgtaacctcgttcccgtacgggtcgggtaccccttacgggacggttcgaagggtaacgtcgtacgggtacggtcttacggtaatttaacgttccgcgggtcttacgtacctataacgttcgccgtacgtacggtacggttaacgtaccgttagggtttacgggtaacgggttaccggggaacgggtaacggtaacccggtagtacccggttaccggtaacccgttaccgggtaggaacccggtacccggaccggttccggtaccccgg

SEQ ID NO: 149872 - DNA, 743 bp, Homo sapiens
  misc_feature: GYAE6OF01DF4LL.19.14.B03.1.454.CMB.1.raw
  modified_base (293)..(293): a, c, t, g, unknown or other
  misc_feature (293)..(293): n is a, c, g, or t
  modified_base (552)..(552): a, c, t, g, unknown or other
  misc_feature (552)..(552): n is a, c, g, or t
tcagtactctcgtgcacgaccggtgctcgatttagtgtgagtagttccgcgggggggtctcaggaggcagcactctcgggacgtctccaccagtggcctgggctcgtgcctccctcctcacgtcccttcctcaccgtcgagggccaacgaggactccgtggggcctcgagtcgtcgccctgaacctcgacgcctacactcgacggttcggttcccgggttcctccgtggaactacggttcacggtacctacctaacttccgttcccgtggacctaccgtaccggaaccaggtntacggtgtaggttggtttcgggtagttaactacgttagtcgtccttaccgtacggtaaaccaacgaccaccggaggacccgaccgaaccctaagcctagtacgttacttagagtacttacgtacgtacgtacgaccgggccccgtaccgtaccgggtaccgggttcctgtaccgtcgttcttcgtctcgggtacctacgtacgcgtacgaaccacgtcccgtaaccctaccctaacgtccgtcgtcgtcggcctacggngtacgtacgacggtgtacggtcgtaacgtcgtttaagtacgttccgtgttcgacgttcctagtacgtagccggacgtacgttacgttacggttaacgttgttacgtccgggttagggaccggtaagtaccgtacgtacccggtaccgtaccggttaccgtacgtccccgaacgtcccggtgttacccccgg

SEQ ID NO: 149873 - DNA, 655 bp, Homo sapiens
  misc_feature: GYAE6OF01AGBG1.19.14.B03.1.454.CMB.1.raw
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
tcagtactctcgtgcacgaccggtgctcgatttagtgtgagtagttccgcgggggggggtctcgaggaggcagcactctcgggacgtctccaccatggcctgggctctgctcctcctcagcctcctcactcagggcacaggatcctgggctcgagtctcgcctgactcagcctcactcagtcggtccgggtctcctggacagtcagtcaccatctcctgccacgtcggaaccagcagtgattggttggtaggttataactntcgtcctctggtaccaacaacaccaggcgaaccgaccccaacgtacatgtattatgntcgtnagtgagtccggcctcgtacgggtcctggctcgtcgttactcgtcggtctcaacgtcgtcgaacacgccgtaccctaccctacncttccgtcgtacgcctacgcggtacgtggtaacggngtacgacggtcgtagaccgtttatacgtcncgttaagtcctagtacgttacgtacggtacgaaggttaccgtacggttaccgttaggttttaccgggtacggtttccgggtaaccgggggacggtaacccggtacggtacccggttacggaaccccgggttcccgggtaacggaacccgttaaccgggacccccggtaaggtttaccccccgg

SEQ ID NO: 149874 - DNA, 771 bp, Homo sapiens
  misc_feature: GYAE6OF01A8BD1.19.14.B03.1.454.CMB.1.raw
  modified_base (392)..(392): a, c, t, g, unknown or other
  misc_feature (392)..(392): n is a, c, g, or t
  modified_base (552)..(552): a, c, t, g, unknown or other
  misc_feature (552)..(552): n is a, c, g, or t
tcagtactctcgtgcacgaccggtgctcgatttagtgtgagtagttccggcgggggggggggtctcagggaggcagcactctcggggacgtctccaccatggcctgggctctgctcctcctcagcctcctcactcagggcacagggatccgtgggctcagttctcgcccctgactcacgtcctcactcaggtcggtccgggtctccgtggactagtcagtccactactcctccgtgctaccgtacggaaccagcgtagtgtaggttgggtttgggttacggtttaataacttagttggttccctccgttacggtaaacccaaaccaacccgaaccccgaagggacccgtaaacccggaccccccgaaaagtccgtagttagttaacttttanaggtatgtacgtaggtggtaccggcccgtccgtccgggtaccgggtcctagtcgttccgtcccttcgtctacggtccctacgaggttcccgacggaccctaaccgacccggtcccttacccaaccgtactccgtcgtcggcctaccgtaggtcgtacggnggtacgtaggtacgtctttagtacttttaacgttgacgttcgtctacttacgtacgttagtcgggacgtacggtacgttaacgggttaccttacgggtttcggttaaccggggtacgggaaccggggtaaccggacccgtaaacggttccgggtacccttacccgggttaccggtaccgggtaaccggtaccccggtaccgggtacccggtccccccgg

SEQ ID NO: 149875 - DNA, 671 bp, Homo sapiens
  misc_feature: GYAE6OF01EDM9K.19.14.B03.1.454.CMB.1.raw
  modified_base (212)..(212): a, c, t, g, unknown or other
  misc_feature (212)..(212): n is a, c, g, or t
  modified_base (560)..(560): a, c, t, g, unknown or other
  misc_feature (560)..(560): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcacatcctccngcacgtggaaccagcagtgagttggttggtagttataacttatgtctccgtacgtaaccaacaacacccgaggaccaaccggaccccaagtacagttagtattatgatcgtagtagtagcgcccgggtacctcggtaccgggttccctagtacttccggtcttcgtcgtcggtcctaccgtaagttccgtcggaaccgaacccgaccccgggtaccccttaaccccgtaacctaccgttcccttaccgggtccgggtcccttacccggacgggtacgtacgggtaggtaggtacggtacgggtccttaagttaccgtttaattccgtgtacgtctacgtactatacgngacgtacggacgttacggtacgttggtttacggtggttacgggcggtaagggtaacctcgaccggttacgaccccggttgtaccggaccgaccggtacccgcggtacccgg

SEQ ID NO: 149876 - DNA, 785 bp, Homo sapiens
  misc_feature: GYAE6OF01AWA41.19.14.B03.1.454.CMB.1.raw
tcagtactctcgtgcacgaccggtgctcgatttagtgtgagtagttccggcgggggggggtctcaggaggcagcactctcgggacgtctccaccatggcctgggctctgctcctcctcagcctcctcactcagggcacaggactccgtgggctcagtctcgccctgactcacgcctcactcagtcgtccgggtctcgtggacagtcagtcaccatcctcctgcacgtacggaaccaagcgagtgtagttggttaggtagttaataactagtcgtcctccgtacggtaacctaacaaccaccaggaccaacgacccccaaagtcagtacgtatttacgtagtactgtactagtgacggccggtcccgtcggaccgggttcctgtactccgtacttcgtctaccgggtcctaccgtaacggtcgtaacggaccctaaacccggacccggtaccccttaccccgtaacctcgttacccgtcggtaccgggtacccttaccggacgggtaccgttaacgggtacggtaacggtacggtacgggtaaccttaggttaacgtttaacgttaccgttacgggtaccttcgttaacccgttagtaaccggttgtaccggaacggtacgtacggttaccggtttaaccgttacgggtttaccgggttaaccgggttaccgggtaacggggtaaccgggttacccggtaaaccgttcccgggttaccggtaaccccgggtttaccgttaccgggttacccgaacccgggtccccggtaaacccggttcccccggg

SEQ ID NO: 149877 - DNA, 746 bp, Homo sapiens
  misc_feature: GYAE6OF01EDHWZ.19.14.B03.1.454.CMB.1.raw
  modified_base (134)..(134): a, c, t, g, unknown or other
  misc_feature (134)..(134): n is a, c, g, or t
  modified_base (175)..(175): a, c, t, g, unknown or other
  misc_feature (175)..(175): n is a, c, g, or t
  modified_base (228)..(228): a, c, t, g, unknown or other
  misc_feature (228)..(228): n is a, c, g, or t
tcagtactctcgtgcacgaccggtgctcgatttagtgtgagtagttccggcgggggggggtctcgaggaggcagcactcgtcgggacgtctccaccatggcctgggctctgcctcctcctcacgcctcctcacncgagggcacgaggactccgtggctcagtctcgccctgactncgcctcactcgagtcgtccggtctcgtagacagtcacgaccacctatcctccngactacgacgaccagcagtgtagttggttaggtagttaactacgtcttcgtactcgtacgtaaccaactaccgaccgacggacgaccgacctaagtctagtagtacttagcgtagtacgacgtagtgtacggtccgtacccgtaggtaccgtcgtacgtcgtcgtccttcgtcgtcgtactcgacgttccgacgacctaccgtcccgtacctacctacgtccgtcgtcggtctacccgtgtacgacgtggacgtcgtacgttactcgttaacttacgttacgttccgaccttcggtacttacgtaggtactacgggttaaccgtacggtaaccggttacgttaacgggtttaaccgttttaacgggttccggggtaaacccggggttacgggaaacccgggttaaccgggtaactaacccggggtttaaacccgggttccccggttaaaaccggggtttccggaaaccccgggtttaccgaaaccccgggtaccccggtttccgggtacccccccggg

SEQ ID NO: 149878 - DNA, 882 bp, Homo sapiens
  misc_feature: GYAE6OF01BYRMO.19.14.B03.1.454.CMB.1.raw
  modified_base (260)..(260): a, c, t, g, unknown or other
  misc_feature (260)..(260): n is a, c, g, or t
tcagtactctcgtgcacgaccggtgctcgatttagtgtgagtagttccggcggggggggggtctcaggaggcagcactctcgggacgtctccaccatggcctgggctctgcctcctcctcagccctcctcactcgagggcacgaggactccgtgggctcgagtctcggcctgactcgacgcctacactcaggtcggttcccgggtctccgtaggactagtcacgtccacctacttcctccgtcgaccacgtacggaaccncgcgtagtgtagttcggttgggttagttaactaacgttacgttcgttaccgttaccgttaccgtaaacccaaaccgtaaccgaacccggacggaaccggaaacccggtaaccccgtaaagtacgtaattacggtttaatttacgtacgtagtacggtacgacggtacgggtaccggacccggtccccggtacggggtaccgggttaccgtacggtcggttacccgttccgtttcgtaccggtaccggtaccctaacggtaccggttaccggtaaccggtaacccgaacccggtaccccgttaccccgttaaacccgtaacccgtaccgtttccgggttaccgggtaccggtccccgttaacgggacgggttaccgtaacgggacggttacgggttaacggcgtttaaacgttacggttaatttaccgtcgttacgcgttaacgtctaagtagtacggtacggtacgtaacgggttacccgtaaggtttacccggttaggtttaccggggtacgggtaacggggaccgggtaaccgggtaccgtacgggttaacccggtacccgggttacccggtacggttaacccggccggtaaccccggtacgggtaccgttccccccggg

SEQ ID NO: 149879 - DNA, 748 bp, Homo sapiens
  misc_feature: GYAE6OF01BMDNY.19.14.B03.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (546)..(546): a, c, t, g, unknown or other
  misc_feature (546)..(546): n is a, c, g, or t
  modified_base (570)..(570): a, c, t, g, unknown or other
  misc_feature (570)..(570): n is a, c, g, or t
  modified_base (579)..(579): a, c, t, g, unknown or other
  misc_feature (579)..(579): n is a, c, g, or t
tcagtactctcgtgcacgaccggtgctcgatttagtgtgagtagttccggcggggggggggtctcaggaggcagcactctcgggacgtctccaccatggcctgggctctgctcctcctcagcctcctcactcgagggcacaggatccgtgggctcgagtcgtcgccctggactcagcctcatcagtcgtccgggtctcgtggcngtcagtcacntcgtcctgcacgtacgacncgacgtagtgtagttgtggttaggttataactgttcgtcgtcgtacgtaaccaaccaacaccgaggaccacccggaccctagtctagtagtacttagtagtacgttgtacgtaggtacgaccggtccggttaccgtacgggtccgggtaccctagtcccgttcgtctttccgtccggtcggttaccttaccggtaacggtttcgaccgaccggtaacccgaccccggttaccccttacctaaaccgttctcccggtcgggttacggacccgtacggaacggtcgttaagggcgttaacgggccggtaacgttntttacggtaacgtttctttacggngtttacccngtaccgttacgattggaccgtaacggggtaacccgtttaacgggttgtttaacgggttttacgggccgttaccggggaaacgggaacggtttccccttaaagggtcccggttaacccgttgggtccggtaacaacccggtcggggttaaccctcccgggtaacccccgg

SEQ ID NO: 149880 - DNA, 860 bp, Homo sapiens
  misc_feature: GYAE6OF01BD33L.19.14.B03.1.454.CMB.1.raw
  modified_base (197)..(197): a, c, t, g, unknown or other
  misc_feature (197)..(197): n is a, c, g, or t
tcagtactctcgtgcacgaccggtgctcgatttagtgtgagtagttccggcgggggggggtctcaggaggcagcactctcgggacgtctccaccatggcctgggctctgctcctcctcactctcctcactcaggacacagggtcctgggcccagtctgccctgactcagtctgcctcgtgtctgggtctcctggacngtcggtcacctatcctcctgcacgtcggaaccagcaggtcgtatggttacggtaaaactttccgtaaccttgtccttaccgtacggttaacccaactactaccaaaccctaaaataaacccgtaccccccaaacgttccaacttacctaagttttactagtactaccggaccctaacgtaaccggcccgggtacccgttaccggttacggggttttacctaacggttccggtacctttccgtccgttcggtaccttaccgtacggttcgtacggaccaaaccgtccggtccccttacccgtacgtaactaacgttcccgttcggtacggggtccctaccggaacgggtcgttacggaacggggtacggtacggtccgttaggtaacctttaacgtaccggttcggtaccttacggtaccttaacgtacttacgggttacggtaccggttaaacggttccggtttaacttccggttttaaccgtttacgtttaccggtttaccggtttaacccggggtaaccggttacccgggtaaacccggtaaccgttaccccggttaaccggttacccgggttaccggtacccggttaacccggaacccccgtaaaccgggtaccccctaaacccgttaccgtaccgttcccgttaaccccgtttaccccg

SEQ ID NO: 149881 - DNA, 729 bp, Homo sapiens
  misc_feature: GYAE6OF01BHF4P.19.14.B03.1.454.CMB.1.raw
  modified_base (161)..(161): a, c, t, g, unknown or other
  misc_feature (161)..(161): n is a, c, g, or t
  modified_base (269)..(269): a, c, t, g, unknown or other
  misc_feature (269)..(269): n is a, c, g, or t
  modified_base (365)..(365): a, c, t, g, unknown or other
  misc_feature (365)..(365): n is a, c, g, or t
tcagtactctcgtgcacgaccggtgctcgatttagtgtgagtagttccgggcggggggggggtctcaggaggcagcactcgtcgggacgtctccaccatggcctgggctctgctcctcctcacgcctcctcactccgagggcacaggctccgtgggactcncggtctcgcccgtgacctcgatcctcgactcgtaggtccgggttccggttctaccgtggactagtcgtacgtaccacctcttcctccgcgtaccgacgtacgaaccgngcgtagtgtagtttgggtggttagtaacttatgtcgttctcgtaacgaaccaacaccgaccgacgaccgaccgaacctagtctattagtattgtanagtctggagcgcggcccggtccgcggtacggtcgcgtcctcgttcgttcgtccgcggtactacggtcgtcggaccgacctacccgggacccttaccccttaaccctccgtaacgttcccgtcgggtaccgggtacccttacgggtcggttcggtaggaacgggttcgtaaggggtacctttaacgttaacgtttaccgttaactttcaggttcggttcctaacgttctaactcggtacggtacggacggtacggttaacgttacggtttaggttcgggttaaccgggtcgggacggtaaccgggtactcggtacggttcccggaacggttcgggacccgacgaccggtccgggtacctcccggg

SEQ ID NO: 149882 - DNA, 756 bp, Homo sapiens
  misc_feature: GYAE6OF01E2N4V.19.14.B03.1.454.CMB.1.raw
  modified_base (156)..(156): a, c, t, g, unknown or other
  misc_feature (156)..(156): n is a, c, g, or t
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtcngccctgactcagcctcactcagtcgtccgggtctcctggacagtcagtcaccatctcctgcactggaaccngcagtgatgttggtgttataactntgtcctcgtagtaaccaacaaccacccgagaccaacgaccccaagtcatagtatttangatgtacagtgacggccggtccctcggaccgggtccagtactccgtccttcctcgtcgtccgtacctaagtccgtacggaaccaaccggtacccggtccccttaaccccttaaccaccgttacccgtccggtaccgggtcccgtacccggtaaccgggtccgttagggaacggttacgtacgggtaacgggtaccgttaaacggtttaacgttttaacgttaccgtacggttaccgtacggtaccctaagttaacgttaacggtcggtaccggtacggtaccgttaacgggttaaccgttacgggtttttacgggtaccgggtttaaccggggggaccgggttaacgggaaacccggtacggtacccggttaacccgggttaaccccggttacggttaacgggaccccgtaaccccggggaacccggtaaaccggggtcccccccgg

SEQ ID NO: 149883 - DNA, 848 bp, Homo sapiens
  misc_feature: GYAE6OF01DPRMU.19.14.B03.1.454.CMB.1.raw
  modified_base (186)..(186): a, c, t, g, unknown or other
  misc_feature (186)..(186): n is a, c, g, or t
  modified_base (384)..(384): a, c, t, g, unknown or other
  misc_feature (384)..(384): n is a, c, g, or t
tcagtactctcgtgcacgaccggtgctcgatttagtgtgagtagttccggcggggggggtctcaggaggcagcactctcgggacgtctccaccatggcctgggctctcgctcctcctcacgtcctcctcactcgagggcacgaggactccgtgggctcacggtctcgtccctgactcacgcctacnctcgagtccggttccgggtctccgtaggacagtcctacgtaccactacgtccttcgacgcacgtacgaacctgcgtagtcgtagttcggtttagggtaacgtttaactaacttgttcggttcctaccgtacggtaaaccaacctaaaccgaccgaagtaccgaaccgaaccctaaacgtctagttcttaattacgtanacgttcgtacgtaggtacggtaccgggtacccggtccgtaccgggtacggttccgtacgtacgtaccgtttccttccggtcgttacgtccgtaccgtaacggttcgtaccggaaacccggtacccggtacccggttaccccttaacccgttaacgttccgttcccggttaccgggtacccggtacccgtaccgggtaccgtaacggtacgggtaaccggcgggttaacgggacggtttaccttacggtttaacgttttccggtttaaccgtcggtttaccttccgtaaacgtttcgaaacggtttacgtccgggtaaccgggttcgggtaaccgtaaaccgggtttttcggtttacggggttaacgttaccggggtaccggggtaaaccggtacgggtaaccgtacgggttacccgtaccgggtacgtacggttacgcccggtaaaccgccggtcggtccccgg

SEQ ID NO: 149884 - DNA, 897 bp, Homo sapiens
  misc_feature: GYAE6OF01BQWO0.19.14.B03.1.454.CMB.1.raw
tcagtactctcgtgcacgaccggtgctcgatttagtgtgagtagttccgggcgggggggggtctcagggaggcagcactcgtcgggactcctccacctagtcggccgtgggctctcgcctcctcctcacgtccttcctcactcgaggcaacgagcttccggtcggctgtacgtcctccgcctacgactacaccgtcctactcgtcgtgggttccggtccggttccgtacgtaggagtacgtctaccgcctacctctccgtccgcgttacgacaaccggtacgacgtagtacggttaggtaggttttcgggtagggttttaactaacttaagttaccgttctcccgtaacgttaaaccgtaacccaaccgtaacgaaccgtcccggaaaccggaccccgtaaaccggtataccgtagttaagttacgtttaggtacgttacggtaccgtaggtaaccggtccggtaaccggtccgggtaaccgttacggggttccgggttctagttccgtacgttccgtacgtccggtaaccggtctaacgttcggaaccgcgaaacccctaacgtccccttacctaaccctactcggtacgtaccggtaccgtcgtacgacgtacggaggtaacgtgggtaacgtcgttaacgttacgttacgttacttacggttctagttaccgtacgttacggtaactacggtaaccggttaacggttaaccggttacggttaaacggtttacggggtttaccgggttttaacgggacggggttaccggggggtaaacgaaacccgggtttaaccgggtacccggggttacccgtttaacccggggacccggtttaccgggttaaacccggtacccgggtacggggttaacccccggtacccgggttccccccgg

SEQ ID NO: 149885 - DNA, 934 bp, Homo sapiens
  misc_feature: GYAE6OF01C1DTF.19.14.B03.1.454.CMB.1.raw
tcagtactctcgtgcacgaccggtgctcgatttagtgtgagtagttccgcggggggggtctcaggaggcagcactctcgggacgtctccaccatggcctgggctctcgctcctcctcacgtcctcctcactcgaggcacgaggactccgtgggctcagtctcgccctgtacctcacgtcctcactcgtacgtcggttccgggtctccgtgggacacgtcacgtaccaacctacttcctccgttcgacgtaaccggtacggaaaccctagaccgtaggttacgtagtttggttacgggttaagtttaacttaaacgtcgttcgtaccttaccgtacggttaaacccaaaccgtaaaccgacccgtaaggaccgaaaaccggtacccccgtaaagtaccgtaacgttacgttaagtttacgacggttacgtacggtaacgaacgggtacggtaccgggtacccggtcccggttaaccggggtcccggtttaccgtacggtaaccgtttccgttaccgtttccgtacgtccggtaccgtaccgttacggtcgttaccggacctaacccggtacccggtcccttaacccgttaacgccgtttcccggtttacgttaccggggtccctaacccgggttagggtaaccgttcggggaaacgggttacggtaccggggtaggtaccgttaacggttttaaccgtttaacgttccgtaacggtccgtttaaccggtaccgttacgtaacggttaacggtccggtaacggttaccgggaacgttacgggttttaaaacccgtttcggggtttaccgggttaacgggggttacccggaaaccggggggtaccttaaccggtaaaccgggttcccgttaaacccgggtttacccggtacccggttaacgggacccgttaacccgtccgggtaccgttaccccggg

SEQ ID NO: 149886 - DNA, 524 bp, Homo sapiens
  misc_feature: GYAE6OF02IQZER.19.14.B03.1.454.CMB.1.raw
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacaccaggcaaggcccccaaaagtcatgatttatgatgtcagtgagcggcctcgaggggtccctgatcgcttctctggctccaagtctggcaacgaccggcctccctaaccactctctcgggctccaggctggagntggagctgattattacngtctgctcatatgctaggtcgtaattctatttagtgttcgttcggtaacgtcgggtaccaaggtcacccgttcgtacggtcacggacccctaaggaccccc

SEQ ID NO: 149887 - DNA, 501 bp, Homo sapiens
  misc_feature: GYAE6OF02I9D00.19.14.B03.1.454.CMB.1.raw
  modified_base (362)..(362): a, c, t, g, unknown or other
  misc_feature (362)..(362): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctctggtaccaacaacacccaggcaaggccccaaagtcatgatttatgatgtcagtgagcggcctcgagggtccctgactcgcttctctggctccaagtctggcaacncggcctcctaaccatctctgggctccgagctgagatgaggctgattatactgctgctcatatgcaggctaggtactacgttggtattcgggcggaggaccaagcgtcgaccgtccgtaggtcacggtcccgaaggtccg

SEQ ID NO: 149888 - DNA, 514 bp, Homo sapiens
  misc_feature: GYAE6OF02ILWQI.19.14.B03.1.454.CMB.1.raw
  modified_base (362)..(362): a, c, t, g, unknown or other
  misc_feature (362)..(362): n is a, c, g, or t
tcagtactctcgtgcacgaccggtgctcgatttagtgtgagtagttccgcgggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggccccaaaagtcatgatttatgatgtcagtgagcggccctcaggggtccctgatcgcttctctggctccaagtctggcaacncggcctccctaaccatctctggctccagctgaggatggagctgattattactgctgctcattatgcaggcaggtactacgttttggatttcgggcggtaagggacccaaggccttagacccggttcctagggtcacggaccccaaggtcccg

SEQ ID NO: 149889 - DNA, 513 bp, Homo sapiens
  misc_feature: GYAE6OF02HT4SW.19.14.B03.1.454.CMB.1.raw
  modified_base (303)..(303): a, c, t, g, unknown or other
  misc_feature (303)..(303): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttangatgtcagtgagcggccctcgacggggtccctgactcgcttctctggctccaagtctggcaacaccggcctccctaaccactctctgggcctccaggctgaggatggaggctgtattattactgctgccttcatatgcaggcaggtactagtttggtagttcgggcggtaggaccaagctgacccgtctaggtcacgtcccgaggtcccg

SEQ ID NO: 149890 - DNA, 521 bp, Homo sapiens
  misc_feature: GYAE6OF02JHCYA.19.14.B03.1.454.CMB.1.raw
  modified_base (364)..(364): a, c, t, g, unknown or other
  misc_feature (364)..(364): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaacggccccaaagtcatgatttatgatgtcagtgagccgcctcgacgggtccctgatcgcttctctcgctccgaagtctggcaacncggcctcctaaccatctctcggctcagctgagatgagtctagattatactgactgacttcattagtgcgaggcaaggttactactttggtaacttcgggacgggtaaggtaccaaggccgtaggacccgtcggtagtccgacggtacccaggtcccg

SEQ ID NO: 149891 - DNA, 498 bp, Homo sapiens
  misc_feature: GYAE6OF02IRIVR.19.14.B03.1.454.CMB.1.raw
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcacatctcctgcactggaaccagcagtgatgttggtgttataactatgtctcctggtaccaacaacacccaggcaaggcccccaaagtcatgatttatgatgtcagtgagcggcctcgaggggtccctgatcgcttctctgctcagtctgcacncgcctcctacatctcnggctccngctgagatgagctgattattacngctgctnatntgcaggcaggtactagtttgtagttccgggcggtacgggacctaagcgtacgacccgttcgtaggtccacggacccgaaggtcccg

SEQ ID NO: 149892 - DNA, 617 bp, Homo sapiens
  misc_feature: GYAE6OF02IN34W.19.14.B03.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (340)..(340): a, c, t, g, unknown or other
  misc_feature (340)..(340): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtcgtccgggtctcgtggacagtcagtcaccatctcctgcactggaaccngcagtnatgttggtgttataactatgtctcctaggtaaccaacaacacccgaggcaaccggaccccaaagtcagtgtattaatgatgtcagtgagccggcctagagggtcccngactcgtcttgtccgtggcctaccgaagttcgtacggacctaaaccgtaccgtccctaaccctaaaccgacttcctcgtacgggtcccgtaccgaagggtcgtacggaaggtaagtcggaacggtcgttacgttaatttaacgttacgcgtcgtcgtctaccgtatacgtacgacgacggtataacggttactaaccgtttggtacgttaccggggacggaacgggaccaacggtcgtagacccggttcgtaacggtcgacggtaccgaaggtcccg

SEQ ID NO: 149893 - DNA, 603 bp, Homo sapiens
  misc_feature: GYAE6OF02HO9TI.19.14.B03.1.454.CMB.1.raw
  modified_base (379)..(379): a, c, t, g, unknown or other
  misc_feature (379)..(379): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctctgcactggaaccagcagtgatgttggtgttataactatgtctctgtaccaacaacaccaggcaacggaccccaagtcatgtattatgatgtcagtgacgcggccctgacgggtcctgactcgcttctctggctcgagtctcggacacgacggtccctaccctaacnctacgtcgtcgggcctaccgaggctaggaggagtggacggtctagtactttagtacgtgtctgtactacgtattagtcgacgtacgggacgtaacggttacttacggttttacgggtacgtttccgggggaacgggtaacgggtaacccgtaacgggtacccggttacggtacccgtttacccggtacgggttaccgaccggtaccccggtaaggttcccccgg

SEQ ID NO: 149894 - DNA, 596 bp, Homo sapiens
  misc_feature: GYAE6OF02J07VS.19.14.B03.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
tcagtactctcgtgcacgaccggtgctcgatttagtgtgagtagttccgcggggggggtcggtcaggaggcagcactctcgggacgtctccaccatggcctgggctctgctcctcctcagcctcctcactcagggcacaggatcctgggctcagtctgccctgactcagcctcactcagtgtccgggtctcctggacagtcagttccaccattctccgtgaccactggaaacccngccagtgatcgttggngttatactatgtctctggtaccaacaacaccaggacaacggacccccaagtccactacgattatgatgtcagtgagccggacctcgacgggtcctgactcggtcttcgtctggtcctaccaagtctacggaccaactacggccctaccctacgactctcgtacgggccttccgaacggtcttggacggatggtacggacttgaacgttattactgtactggtcctcgatacgtcgcaacgggctaaggtacttacgttcggttaagtcgggtaccgggtaacggccgtaacggacttcggtaacccggttccttaccgggacgttaccggaccgacggttacccg

SEQ ID NO: 149895 - DNA, 657 bp, Homo sapiens
  misc_feature: GYAE6OF02I6ZN7.19.14.B03.1.454.CMB.1.raw
  modified_base (303)..(303): a, c, t, g, unknown or other
  misc_feature (303)..(303): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctggtaaccaacaacaccaggcaacggccccaaagtcatgattatnatgtcagtgagccggcctgacgggtcctgatccgtctctcgtgcctacaagtcgtcggacaaccgaccggcccttacccgtaactattccgtcgtcgggccttaccgagggtacctaggaacgggtacttacggaacggttccgttaggtaaactttaacgtttaacctcggtccgttacgctttaacctaagttaacgttcgacgtaacgggtacaaacgggtttaccttacggttttagggtacgttaccggggtacggggtaacgggtaacccaaacggttcccggttaacggtaccccggttacggttaaccggggtacccgaaccgggtaaccccgtaagggtccccgg

SEQ ID NO: 149896 - DNA, 673 bp, Homo sapiens
  misc_feature: GYAE6OF02I1AHZ.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctgtaccaacacaccagcaacggaccccaaagtcatgtattatgatgtcaagtgacgcggcctgacgggtccctgatcgtcttctctcggctcctaagtctgacaaccgacggtccctaccctaacctactctacgtcgggtcctccgtagggctaggacggtagttacggaaggtcttagacgttttaacttacgtcgaccgttcggtacccttacgtaacgtacgttacgtaccggtaacgggtaccgtaaacgggttaaccttaaccggtttttacgggttacggtttaacccgggggtaccgggtaaacggggtaacccggttaaacgggttccggttaaccccggttacccggtttaacgggtttaacccgaaccgggtacccccgtaaacgggttcccgttaaccccccggg

SEQ ID NO: 149897 - DNA, 759 bp, Homo sapiens
  misc_feature: GYAE6OF02JHY1M.19.14.B03.1.454.CMB.1.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagtactctcgtgcacgaccggtgctcgatttagtgtgagtagtttcgggttggggggggggtcacgaagacggcacgcgctctccgggacgtctccaccatggcctgggctctgctgctacctcactctcctcacctcaggactacgaggtcctagggcccagttccttgccctgtaactcacgtctgcctcggtgtcgtgggtctccgtaggactagggtcggtcaccgatcgtcctgcacgtcggaacngctagtgatgtagaacttctaaccttgtctctcgtacaantccaccaaataacgcccctaaatcgtactctattacacgacgtcgacctaacgtaacggtccggtccctacgtagggtttactaacgtcgtacttactcgtacggtaccttaccgtaacgttccgtacggtaccaaaccgtaccggtcccttacccgtaggaaccgtaacttccgttaccgtacgggtaccctaccggtacggtccgtaacgggaacgggtaaccggtacggtaccgttaacggtacctttaaccgttacgtaccgtacgttacgtaccgttactaagttacgtacggtaccgtacggttaccgttaacttaccgtttacgtttacgtttcgtttaccggttacggtaaccgttacgggtaaccgtaaccgggtaccctaacccgttaccgttacggtacccgtaacgacccggtaaccggaccccttaacccgtacgttaccgtaccgttacccg

SEQ ID NO: 149898 - DNA, 659 bp, Homo sapiens
  misc_feature: GYAE6OF02JAGYI.19.14.B03.1.454.CMB.1.raw
tcagtactctcgtgcacgaccggtgctcgatttagtgtgagtagtttagggtttaggggggggggtcacgaacgaggcagtcgcttcctccgggaccgtctccaccatggcctgggctcgtgcgtgacgtcctcactctcctcactcaggacacagggtcctgggcccagtctgccctgactcagtctgcctcgtgtctgggtctcctggacagtcggtcaccatcgtcctgcactggaaccagcagtgatgttggaaattcctaaccttgtctcctggtaccaacataccaacccaaaataaacgaccccccaaactcatactatttatgatcgccaactaagccggccctcgtagggtttctaatccgtcttctctggcctcaacgtctggacaacacggtccctcccgtagaccaagttctcgtcgggcctaccgaggctggaaggtatagggaggtcttagtaatttacttactggtccttgccttacattacgtcgtaccgagggtcgtaacgggttaacgttaccgttttgggttaacgttcggggaccgggtacgggaaccctaaggtccgttacggtacccggttaccgttacggttaccgaaccgtaccccggaacggtcccgtacccggtcccccgttaccggtacccg

SEQ ID NO: 149899 - DNA, 547 bp, Homo sapiens
  misc_feature: GYAE6OF02FYWQH.19.14.B03.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggccccaaagtcatgattangatgtcagtgagcggccctnaggggtccctgactcgcttctctcggctccaagtctgaccaacaccggcctaccctaaccatcctacgtcgggcctccgaggtctggaggatggaggctgattattactgctgctcatatgcaggctaggtactacgttttggagtttccgggacgggacgggtaacccaaggtccgttacggacccgttccgtaacgggtccacggtaccccgtaagggtccccg

SEQ ID NO: 149900 - DNA, 586 bp, Homo sapiens
  misc_feature: GYAE6OF02IUDXN.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctgtaccaacaacaccagcaacgccccaaagtcatgatttatgatgtcagtgagccggccctcgacggggtcctgactcgtcttctcgtggctccaagtctcggacaaccgaccggccctaccctaaccactcctcgtcgggcctccgaggctaggaggtatggacggtcttaggtatttacgttactcgtcttgacttacgtaattacgtgacgtaggcgtaaggttaccgttacgtttgggtaacggtttccgggacgggtaacggaaccgtaagtccggtacggtacccggttccgtacggtcgtaaccggtacccgtaaggtcccg

SEQ ID NO: 149901 - DNA, 711 bp, Homo sapiens
  misc_feature: GYAE6OF02IC9GH.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctccgtggacagtcagtcaccatctcctgcactacggaaccagcagtgatggttggtagttataactatgtctcctggtaccaacaacaccagacaaccgacccaaagtcatgtatttatgatgtcagtgagccggccctcggacgggtcctgacgtcgtccttcgtcgtcggtacctaccgtaagttccgtcgggaccctaacccgaccgggtcccccttaaccccgtaaaccctactttcccgtaccggttccggggcccttacccggtaacgggtccgtagggaacgggtacgtagggaacgggttccgttagttaacttttaacgtttacgtcgtcgttacgacttaccgtaattaacgtgtaccgaagggtaccgtaacggtttaccgtacgtttttacgggtaacggttttccggggaccgggtaacggggtaaccctaaacgggttccgttacccgggtaacccggtttccggtaaccgggttacccgaacggtacccccggtaacggttcccccgg

SEQ ID NO: 149902 - DNA, 627 bp, Homo sapiens
  misc_feature: GYAE6OF02ISE14.19.14.B03.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctcctgcacgtggaaccagctagtgattgttggtgttataactatgtctcctaggtaaccaacaacacccgaggcaaacgggaccccaagtcgattacgtatttagngaattgtacagtacgacggtccggtcccgtcgtacgggtccctggtatccgtcttctcgtcggctaccgtaagtcgtaggcaaacgtccgcctaccctaaccacttccgtacgtcgggtacctaccgtacgggcttagggaacggtagtcggaacgggtcgttaagtaacgttttaacgtaccgtgtccttggccttacgtactagtcgacgtacggacgtaaggtacttacgttgttaacgttcgggacgggacggtacaaggtccgttaggacccgttacgtacggtacgtaccgtcccgtaaggtcccg

SEQ ID NO: 149903 - DNA, 542 bp, Homo sapiens
  misc_feature: GYAE6OF02FIVHM.19.14.B03.1.454.CMB.1.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctggtaccaacaacaccagcaacggccccaaagtcatgatttangatgtcagtgagcggccctcgacggggtccctgatcgcttctctggctacagtctgcacncgcctcctgacatctctcgggctcagctagaggacgnggctagtagttactactcgctcgctcaattagtcgacgtacggttacttacttcttactttacgtcgtacgttacggtaacgtcgggaacctaacggtcctacccggtaccgttaaggtccaaccggacccgaacggtaccccc

SEQ ID NO: 149904 - DNA, 587 bp, Homo sapiens
  misc_feature: GYAE6OF02IAVYN.19.14.B03.1.454.CMB.1.raw
  modified_base (295)..(295): a, c, t, g, unknown or other
  misc_feature (295)..(295): n is a, c, g, or t
  modified_base (384)..(384): a, c, t, g, unknown or other
  misc_feature (384)..(384): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctcctgcactggaaccagcagtgatgttggtgttataactatgtctctgtaccaacaacaccagcaacggcccaagtcatgattangatgtcagtgacgccggcctcgacggggtcctagacttcgcttctcgtggctaccagtctggaccaaccgacggtccctaccctaaacncttcctcgtcgggcctccgaggcctaggacggtatggaggtcttagtactttagttactgcttgaccttacattagtcgacgtacggactaacgggttactacggtttaggttaacggttccggggacgggtaacgggaccgtaacggtccgtaccggtaacccggttccgtaacgggtccgaacggtaccccgaaggtcccg

SEQ ID NO: 149905 - DNA, 504 bp, Homo sapiens
  misc_feature: GYAE6OF02HEMRO.19.14.B03.1.454.CMB.1.raw
  modified_base (360)..(360): a, c, t, g, unknown or other
  misc_feature (360)..(360): n is a, c, g, or t
  modified_base (410)..(410): a, c, t, g, unknown or other
  misc_feature (410)..(410): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagcggccctcgagggtccctgatcgcttctctggctcagtctggcacncgctccctaccatctctggctccaggctgaggatgaggctgattattacngtctgctcattatcgcaggcagtactactttggtattcgggcggagggaccgaagcgttacgaccggttccgtaggtcacgcccgaaggtcccg

SEQ ID NO: 149906 - DNA, 613 bp, Homo sapiens
  misc_feature: GYAE6OF02HRXCV.19.14.B03.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctcctgtaccaacaacaccaggcaacggccccaaagtcatcgatttatgatgtcagtgagccggcctcgacggggtccctgactccgcttcctcgtcggcctaccgtaagtcctcggacctaacgaccggtcccttacccctaacctacttcctaccgtgggccctccgacgggcctaggacggtagtggacggtcttaggtactttaatttacgtgtcttcggtccttacgtataagtcgacgtagggctaagggttaccttagttttacggttacgttcggggacgggtacgggtaaccgtaaggttcgacccggttacggtacggtaccgaccggtacccgaggtccctaccccgg

SEQ ID NO: 149907 - DNA, 556 bp, Homo sapiens
  misc_feature: GYAE6OF02IZ4PU.19.14.B03.1.454.CMB.1.raw
  modified_base (227)..(227): a, c, t, g, unknown or other
  misc_feature (227)..(227): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgtggtgttataactatgtctcctggtaccaacaacaccaggcaaggcccccaaagtcatgatttatnatgtcagtgagcggccctacgacggggtccctgactcgtcttcctctggctccaagtctggacaacaccggtcctacccgtaacccactccctacgtcgggtccttcccgaggtctaggaaggactcggaggcttggtattattactgtctgctcatatgctaggctagtacttacgttggttacgtcgggtacgggacgggtaacaacggtcgtacgaccggttaccgtacggtcacggtacccgaggtcccg

SEQ ID NO: 149908 - DNA, 715 bp, Homo sapiens
  misc_feature: GYAE6OF02IGV43.19.14.B03.1.454.CMB.1.raw
  modified_base (298)..(298): a, c, t, g, unknown or other
  misc_feature (298)..(298): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctgtaccaacaacaccagcaacggccccaaagtcatgatttangatgtcagtgagccgccctcgacgggtcctgactcgtcttctcgtcggctaccgtaagtccgtaggaccaaccgtaccgggccccttacccgtacgaacctaaacgttccgtacggttacggggtcccttacccggacggggtacccgttaggggaaacgggtaaccgggtaacgggtaccgttacggtaaacttttaacccgtttaacgtccggtccttacgggtacccttacgtaactttaacgtcgtaacccgtaagggttaccgttaactttccgttacgttttaagtcggttttaccggtttaaccgggtaaccggttaccggggaacccggttaaacgggttcccgtaacccgggttaccggttaaccgggttacccgaaccgggtacccccggtaaccggtaaccccccg

SEQ ID NO: 149909 - DNA, 507 bp, Homo sapiens
  misc_feature: GYAE6OF02F7UDM.19.14.B03.1.454.CMB.1.raw
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaacggcccccaaagtcatgatttatgatgtcagtgagcggccctnaggtcgtccctgactcgcttctctggctcaagtctggcaacncgcctccctaacntctctggctcngctgagatgagctgattatactgctgctcatntgcaggctaggtactacgtttggtacgttcgggacggagggaccagtcgtcggtaccgtccgtaggtaccacgacccgtaacgg

SEQ ID NO: 149910 - DNA, 661 bp, Homo sapiens
  misc_feature: GYAE6OF02JQKRS.19.14.B03.1.454.CMB.1.raw
  modified_base (305)..(305): a, c, t, g, unknown or other
  misc_feature (305)..(305): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtcgtccggtctcctggacagtcagtcacatctcctgcactggaaccagcagtgagttgttggtagttataactgtgtctctagtaaccaacacaccaggacaacggaccccaagtcatgtacttangtatcgtctagtcgacgccggtccgtcggacgggtccagtactccgtctcgtcgtcgtctactaacgtcgtacggactaaccgtccgtaccctaccgtaacctacgtccgtaccgttcgggaccctaccggtaacggtccgtagggtacggtacgtacggtacggtccttaaggtaaatttaccgttaacgtcggttaccgtacgttctaccgtaattcgttacgacgtaggtccggttaacgttacgtacgttttacgggtacgttaccgggaaccgggttaaggaaccggtacgtaccgttcgggtaacccgttccgggttaccgtacgaacccgtaccgggtacgtaccccgg

SEQ ID NO: 149911 - DNA, 518 bp, Homo sapiens
  misc_feature: GYAE6OF02G2A07.19.14.B03.1.454.CMB.1.raw
  modified_base (301)..(301): a, c, t, g, unknown or other
  misc_feature (301)..(301): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctggtaccaacaacacccaggcaaggccccaaagtcatgatttangatgtcagtgagcggccctcgagggtccctgactcgtcttctctggctccgaagtctggcaacaccggccctaccctaaccactctctcgggctccgaggctggagatggaggctgaattattactgactgctcatagtgcaggcagtactacgtttggtattcgggcggaggacaagcgtacggacccgtcgtaggtccacgtcccgaaggtcccg

SEQ ID NO: 149912 - DNA, 824 bp, Homo sapiens
  misc_feature: GYAE6OF02H9WKB.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatccgtgggctcagtctcgccctgactcagcctcactcagtcgtccggtctcgtggacagtcagtcaccactctctgctactacggaaccagcagtgagttggttggttagttataactatgtctcgtacgtaaccaacaacaccgaggaccgaaccggaccccaaagtccaagttacgttaactttattagtcgtacgtagtaggacggtccggtcccgtacggtaccggggttccctaggtaccttccggttctttccgtcgttacggtacccttaccgtaacgttccgtacggaaccgtaacccggtcccggtaccccttaccccgtaaaccctcgttcccgtaccggttccggggtaccctaccggtagggtacctagggtaacgggttacgtacggtaacggtaccgtttacgttaacgttttaaccgttccgtcgtaaccgttccgttacccgttaacttaacggttaccgttacgggaccgtaaacgggtccggttaaaacggtttaccgtttaacgggttttacggggttaaccgggttaccggggggtaaccggtaaacgggtaacccgttaacgggttaccccggttaaccgggttaccccggttaccgggttaacgggttaaccccggtaaccgggtaacccggttacccgggtccccggttaccccccggg

SEQ ID NO: 149913 - DNA, 582 bp, Homo sapiens
  misc_feature: GYAE6OF02GK0BC.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctctggtaccaacaacaccaggcaaggccccaaagtcatgatttatgatgtcagtgacgccggcctcgacggggtccctgactcgtcttctctcggctccgaagtctggcaacgaccggtccctaccctaaccacgtcctacgtcgggcctccggaggccgttaggacggtagtggacggtcttagtatttactacgtgtctgctactagtatcgacgaggcgtaaggtactacgtttgggtacgttcggggcggtaacgggacctaaggtccgttaccggtacccgttccggttaacggtccgaaccggtaccccgaagggtccccg

SEQ ID NO: 149914 - DNA, 649 bp, Homo sapiens
  misc_feature: GYAE6OF02JQH5T.19.14.B03.1.454.CMB.1.raw
  modified_base (141)..(141): a, c, t, g, unknown or other
  misc_feature (141)..(141): n is a, c, g, or t
  modified_base (176)..(176): a, c, t, g, unknown or other
  misc_feature (176)..(176): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
tcagtactctcgtgcacgaccggtgctcgatttagtgtgagtagttccgtcgggggggtcgtcgaggaggcagcactctcgggacgtctccaccatgcctggctctgctcctcctcagcctcctcactcgagggcacaggntcctgggctcagtctgccctgactcagcctcactnagtgtccgggtctccgtggacagtcagtcaccnttcncctgcactggaaccagcagtgattgtggttagtataactatgtctctgtacacacaccagcaacgacccaacgtcatacgtattatcgtatagtcagtgagcgaccgcgtacgggtcctcgatcgtcttcgtcgtacgtctcgtaacgtccgtacgaccgaaccgtaccgcccgttacccaaccctacgtctacgtcgggtcctaccgacggtacgtggacggtaagtcggaggttaccgtaggttaactttacgttaccgtacgtcgttacgtaccttaacgacgttaacgtcgtacccgtaggtaccggaagtttacccggttaacgtttcggtttacggttttaaccgggaccggggtaaaccgtacggtaaccgtacggtaccgtacccgttacggtaccggtacgtaaccggaccggtaccgtaccccggg

SEQ ID NO: 149915 - DNA, 546 bp, Homo sapiens
  misc_feature: GYAE6OF02JV0RI.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctctgacactggaaccagcagtgatgttggtgttataactatgtctctgtaccaacacaccagacaacgcccaagtcatagtattatgatgtctagtgacgccgcctcgacgggtcctgactcgtcttctcgtcgctcgacgtcgtcggacacgaccgcccttacccgactacgtcctacgtcggcctccgacgcgtagacgtgtggcgattacgtattactactgtacttgctatatagtcgacgtagcgtaaggtacttaggttggtacgttcgggcgggaacgtaccgtagtccgtacggaccgtacgtacggtacgacgtaccgacgtcccgg

SEQ ID NO: 149916 - DNA, 618 bp, Homo sapiens
  misc_feature: GYAE6OF02F6SIX.19.14.B03.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatcctctgcactggaaccngcagtgatgttggtggttataactatgtctcctgtaccaacaacaccagcacgaccccaagtcatgattatgatgtcagtgacgccggccctcgacggggtccctgactcgtcttctcgtggcctccaagtcgtcggaccaacgaccggccctaccctaaccacttccgtccgtcgggtcctccgaggtccgtaggacggacgtggacggtctagtactttacgttactcgtcttcgccttacgtattacgtcgtacgacggacgtaacggttaccttaggtttttacggtacggttaccggggacggggtaacggtaccgtaacggtccgttaccggtacccggtaccggttacgggtacccgtaacggtaccccgtaacggtcccccgg

SEQ ID NO: 149917 - DNA, 660 bp, Homo sapiens
  misc_feature: GYAE6OF02JDLPZ.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttatactatgtctctagtaccaacacaccagcaacgaccccaagtcatgatttatgatgtcagtgacgcgccctacgacggggtcctgtactcgtcttctccgtcggtacctaccgtaacgtccgtcggtaccgaaccgtaaccgggtaccccttaccccgtaaaccctacgttcccgtttacggtccggggtacccttcccggtaggtacccgtagggtaacgggagttcggaacggttcttaagtatttacttagtgtcttacgtccgtactaatgtacggacgacggtaccgtaaggtttacctacgggtttttacgacggttccggggaacggggtaaccggaacccgtaaggtaccgttaccggacccgttaccggtaaccggtcccgaacgtaccccggaacggttccccgg

SEQ ID NO: 149918 - DNA, 564 bp, Homo sapiens
  misc_feature: GYAE6OF02G3L34.19.14.B03.1.454.CMB.1.raw
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctctgtaccaacacaccagcacgccccaagtcatgattangtatgtcagtgagccggcctcgacgggtcctgactcgcttctctgctcagtctgcaacgaccgcctacccaaccactcctcgtcggcctccgaggctaggagtatggaacgcttgtatttacttacgtgtctcgcttcgaattcgtcgcgacggtactaaggttacctacgtttaggtacgttcggggaccggtaacgggaaccgtaacggtccgtacggtacccgttaccggtacggtacccgtaacggtaccccggtaagggtcccccg

SEQ ID NO: 149919 - DNA, 716 bp, Homo sapiens
  misc_feature: GYAE6OF02IO5E1.19.14.B03.1.454.CMB.1.raw
  modified_base (174)..(174): a, c, t, g, unknown or other
  misc_feature (174)..(174): n is a, c, g, or t
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
tcagtactctcgtgcacgaccggtgctcgatttagtgtgagtagttccgtcggggggggggggttcgtcaggaggcaggccaatctaccgggacgtctccaccactggcctgggactcctggctcctcctcctacgccctcctcactcagggccagaggatcctggctcagtcngcctgactnagcctcactcagtgtcggtntccngacngtcagtcacatctcctgcacgtggaaccacgccagtcgagttgttggtagttataactattcgtctccgtggtacctaacaacacccaggcaacggccccaaagtcacgtcgtacttagtagatgtctaggtcgaggtccggtcctacgacgggtccctaggacgtccggtcttacctacgtacgtctaccgtaacgtcgtaggacctaacgtaccgggtaccctacccgtaaaccgacttaccgtacgtcgggaccttccgaacggtccttaggaacggtaactacgggtaacggtcgttaagtactttaacgtttactcggtacttcgtacttacgtaacttaacgtacgaacccggtaagggtacccgtaaacgggttaccttacggttttaggttaaccggttaccggggaacgggtaaccgggaaccgtaacggtccggttaaccggtacccgggttacggtaacggtaccggaccgggtaacccgtaggttaccccggg

SEQ ID NO: 149920 - DNA, 605 bp, Homo sapiens
  misc_feature: GYAE6OF02JBUK5.19.14.B03.1.454.CMB.1.raw
  modified_base (226)..(226): a, c, t, g, unknown or other
  misc_feature (226)..(226): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttataactatgtctctgtaccaacaacaccagacaacggaccccaagtcatcgtatttatgatgtcagtgacggccggtccctcggacgggtcctgactccgtcttctctcgctacctagtctggaccaacgccgcctaccctaactctcctcgtcggcctccgcggtctaggacggtagtggacggtcttagtactttacgttacgtcgtcttcgacttacgtattagtcgacgaacggcgttaacgggttaacgttaccggtttggttaacggttcggggaacgggtaaccggaccgtaacggtccgttaccggtacccgttacccggtaggtacccgtaccggtacccgtacggtccccgg

SEQ ID NO: 149921 - DNA, 606 bp, Homo sapiens
  misc_feature: GYAE6OF02JZJK8.19.14.B03.1.454.CMB.1.raw
  modified_base (226)..(226): a, c, t, g, unknown or other
  misc_feature (226)..(226): n is a, c, g, or t
  modified_base (351)..(351): a, c, t, g, unknown or other
  misc_feature (351)..(351): n is a, c, g, or t
  modified_base (503)..(503): a, c, t, g, unknown or other
  misc_feature (503)..(503): n is a, c, g, or t
tcagtactctcgtgcacgaccggtgctcgatttagtgtgagtagttccgcgggggggggtcgtcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctcctgcactggaaccngcagtgatgttggtggttatactatgtctctcgtacaacaacaccaggcaaggccccaaagtcatcgattactgatgtcagtgagccggtaccctcgtacggggtccctagacgtccgctttccncgtcggctacccgaagtcgtggtaccacgtaccggcccttacccgtaactactcttccggtacggtcctaccgacggtcttacggacgggtactcgggaacgtccgttaggtacttaacgttacctggtacctcggtcctacgtattacgtnacgttaacggctaagtacgtacgtttagtacggttaccggcggacgggtaccaaggtcctaccggtacccgttacggtaggacctacggcccgtaacgtcccg

SEQ ID NO: 149922 - DNA, 575 bp, Homo sapiens
  misc_feature: GYAE6OF02I5DJ7.19.14.B03.1.454.CMB.1.raw
  modified_base (302)..(302): a, c, t, g, unknown or other
  misc_feature (302)..(302): n is a, c, g, or t
  modified_base (465)..(465): a, c, t, g, unknown or other
  misc_feature (465)..(465): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctctgtaccaacaacaccaggacaacgccccaaagtcatgtattangatgtcagtgagcggcctcgagggtccctagtactcgtcttctcgtggctaccgaagtctcggacaacgaccggtccctaccctaaaccacttccgtcgtcgggtcctcccgtaggccgtggacggtatcggagtctaggtaattacttacgtgcttcgtctnaattagtcgacgaggactagtactacgtttggtattcgggaacggtaacgggaacctaaggtccgtacgtacccggtccgttaggacccgtacggacccgtaaggtcccg

SEQ ID NO: 149923 - DNA, 662 bp, Homo sapiens
  misc_feature: GYAE6OF02IS22U.19.14.B03.1.454.CMB.1.raw
  modified_base (527)..(527): a, c, t, g, unknown or other
  misc_feature (527)..(527): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtcgtccgggtctccgtggacagtcagtcaccatcctcctgccactacggaaccagcagtgattggttggtggttaataactatgtctccgtcggtaaccaacaacaccaggacaacggaccccaaagtcatgtattagtgatgcagtgacggccgcctacgacggggtcctgactcgtcttcgtcgtcggtcctaccgtaagttccgtaggaccaaccgtacccggtacccttaccctaacctactccgtcgtcgggtaccctaccgtagggcttaggaacgggtatacgggtacggtcttaggttaatttacgttacgttcgaccgttgtacttactaagtttcgngtaccgaacgggtacgttaacgggttaccttaacggttttacgggttacggttcggggtaaccgggtacggggaaacctaacggtccgtaccggttaccgttacccggtacggtcgaacgtccggtacgtaccgg

SEQ ID NO: 149924 - DNA, 528 bp, Homo sapiens
  misc_feature: GYAE6OF02HHOL4.19.14.B03.1.454.CMB.1.raw
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
  modified_base (392)..(392): a, c, t, g, unknown or other
  misc_feature (392)..(392): n is a, c, g, or t
  modified_base (396)..(397): a, c, t, g, unknown or other
  misc_feature (396)..(397): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgccactggaaccagcagtgatgttggtagttatactatgtctctgtacaacaacaccagcaacgccccaaagtcatgattangatgtcagtgagcggccctcgacgggtcctgatcncttctctgctccagtctgcaacgaccggcctaccctaaccactctcgtggcctccaggtcngagnnggagctgattatactgtctnctnatatgacgagctaaggtactacgttgtacgttcgggacgggtacgggaaccgaacggtccgtacggtacccgttacgtacgggttaccaacggcccgaacggtacccg

SEQ ID NO: 149925 - DNA, 559 bp, Homo sapiens
  misc_feature: GYAE6OF02F3V2X.19.14.B03.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccngcagtgatgttggtgttatactatgtctctggtaccaacaacaccagcacgccccaagtcatgtattatgatgtcagtgagcggccctcgacggggtcctgactcgcttcgtctggcctcaagtctggcaacgccggccctacccgtaactctctcgtggcctccgaggctggagtagtggaggctagtacttagttactgtctacgctcatacgtgacaggacgtacggttacttagtttacgggtacgttccggggacgggtacgggtaacctaacggtccgtacggtacccggttaccgtacgggtccgaacggacccgtaggtcccgg

SEQ ID NO: 149926 - DNA, 591 bp, Homo sapiens
  misc_feature: GYAE6OF02HFWGJ.19.14.B03.1.454.CMB.1.raw
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgtggtgttataactatgtctctgtaccaacacaccagcaacggcccaagtcatgattatgatgtcagtgaggccggccctgacgggtcctgactcgtcttctcgtgtcctacagtctcggacaaccgaccggtccctacccgtaaccncttctccgtgggcctccgacggtctaggaaggtntaggaggtctagttattaacgttactcgtactcggacctataattcgtgtacagggtctaacgggttaccttaggtttacgggttagttccggggacgggtaacgggtaaccgtaagtaccgtacggtaacccgttcggttaacggtaccaccgggtacccgtacggtccccgg

SEQ ID NO: 149927 - DNA, 647 bp, Homo sapiens
  misc_feature: GYAE6OF02GIN3L.19.14.B03.1.454.CMB.1.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (499)..(499): a, c, t, g, unknown or other
  misc_feature (499)..(499): n is a, c, g, or t
tcagtactctcgtgcacgaccggtgctcgatttagtgtgagtagtttgggtttaggggggggtccaacaagacggctagcgctcctcgggacgtctccaccatggcctgggctctgctgctcctcactcttcctcactcaggacacagggtccctgggccccagtcctgccctgactcgagtctgcctcgtgtctgggtctctggacngtcggtcaccatctccgtgccactggaaccngcagtnattgtgaaattctaacttgtctcgtggtaccaacagtccaccgaaataaacgccccctaaatcatcagtttatgatcgaccactaagcgccctgaagggtttctaatcgacttctctggtactccgagtctgcaacgacggtcctaccctgaacaactctacgtcggacctaccgaggctacggaacggacgagggctagacgttactacgtgcttgcctacaattacgtcgtacgtaggttcctattccgttnttaacgtcggttaccgttaaccgggtacgttaccgggtaaccgtaacggggttcccgtaacccggttccggtaacggttacccgaaccgggtaccccgaaccggggtacccccaaaccccggttacgttacccggtaccttaaccccg

SEQ ID NO: 149928 - DNA, 671 bp, Homo sapiens
  misc_feature: GYAE6OF02JYKTY.19.14.B03.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (323)..(323): a, c, t, g, unknown or other
  misc_feature (323)..(323): n is a, c, g, or t
tcagtactctcgtgcacgaccggtgctcgatttagtgtgagtagttccgcgggggggggtcgtcaggaggcagcactctcgggacgtctccaccatggcctgggctctgctcctcctcagcctcctcactcagggcacaggatcctgggctcagtctgccctgactcagcctcactcagtcgtccgggtctcctggacngtcagtcaccatctcctgcaccgtaggaaccngccagtgatgttggtagtatactatgtctactgtaaccaacaaccaccagcaacggaccccaaagtcatcgtattactgtaatgtctaggtnacggtccggccgtacgacggggttccctgtacgtcgtcttccgtcgtacggcctaacgtaacgtctacggtaccaaccggtacccgcccttaccctaaccgaccttcgtacgtcgggacctccgacggtctaggtaacggtacgtcggacggtcttaggttaactttacgtacgttcgtccgtacgttcctagtacgttaggtacgtaccgtaacgggtaccgtaacgttaccgttaccggtttagttaccggtttaacggggccgggtacggtaaacccgtaggtaacccgttccggtaaccggtacccggtttaggaacccaccggttacccgaggttacccccgg

SEQ ID NO: 149929 - DNA, 714 bp, Homo sapiens
  misc_feature: GYAE6OF02IQAYM.19.14.B03.1.454.CMB.1.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
tcagtactctcgtgcacgaccggtgctcgatttagtgtgagtagttccgcgggggggggtcgtcaggaggcagcactctcgggacgtctccaccatggcctgggctctgctcctcctcagcctcctcactcagggcacaggatcctgggctcagtctgccctgactcagcctcactcagtgtccgggtctcctggacagtcagtccaccatctcctagcacgtggaaccancagtgactggttggtagttatactatcgtctccgtgtaaccaacaacccaccncggacgaacccggtacccctaaagtactactagttatttancgtactgttacgagtcggacggccggtccccgtacggtacggggtccctaggcttccgtcttccgtcgtcgggccctacgtaacggtcgtcggaacctacccggtaaccgggtcccctaacccctaacccgtaccgtcccgttccgggtccgggtacccgtaccgtacgggtaccgttcggaacggttacggagggtacggtacgttacggttactttaccgtttacgttccgtacgttcgttaccttactaggttactcgggtacgtacgggtacgaacgggtttaccttacgtttacgggtacggttccgggaaccgggtacggtaaccggtacgtcgtaccgtaccgggttccgaggtcccgtaaccggcccgtaacggttccccg

SEQ ID NO: 149930 - DNA, 624 bp, Homo sapiens
  misc_feature: GYAE6OF02IB9HL.19.14.B03.1.454.CMB.1.raw
  modified_base (228)..(228): a, c, t, g, unknown or other
  misc_feature (228)..(228): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
tcagtactctcgtgcacgaccggtgctcgatttagtgtgagtagttccgcgggggggggtcgtcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcgtgacatggaaaccngtcagtgtagttggtttggtacgttaataactagtcgtctccgtacgtaaccaacaaccaccgacgacaaccggtacccaagtactatatattatagatgtactagtgacgccgtccgtacggtacggtcngntcgtctctcgtcgtctacgacgtcgtcgacacgccgtaccctacctaactctcgtcgcggtcctacgcgcgtaggacggagtggacgtacgttagttattacttcgtcgtctacgtacgtactaagtacgacgtaccgtaacggacgttaacggttaacgttacggtttacgggtacgttacggggaaccgggtaacggaaccgtaacgtacgtaccggtaccggttaccgtacgggtacccgacggtacccgtacggtcccg

SEQ ID NO: 149931 - DNA, 615 bp, Homo sapiens
  misc_feature: GYAE6OF02F2TON.19.14.B03.1.454.CMB.1.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagttccgtcggggggggggtctcaggaggcagcactctcgggacgtctccaccatggcctgggctctgctcctcctcagccgtcctcactcagggcacaggatcctggggcctcgaggtctgcccgtgactcagccgtcactcagtgtccgggtctccgtggacagtcagtcaccatcctctgctactggaaccngcagtgatgttggngttataactntgtctctgtaccacacaccagcacgcccaagcatgatttangtatgtcaagtgacgcggtcctcgacgggtcctgactcgtcttctcgtcgcctcgaagtctcgacacctaccggccttaccctaaccgtctacgtcgtcggccttcccgaggtcctagggacggtagtacggaggtaccttggtaacgtttacgtacgtggtctacggtactccgtaagttaacgtcggacgtgggtaaccgtagggttaacctcggttttacgggtagttcccggggtagggttaaccggtaacgtacgttacgtaccggtaccggttaccgtacggtcgaccggtacccggaagtccccgg

SEQ ID NO: 149932 - DNA, 543 bp, Homo sapiens
  misc_feature: GYAE6OF02I90EX.19.14.B03.1.454.CMB.1.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcacatctcctgcactggaaccagcagtgatgttggtgttataactatgtctcctggtaccaacaacacccaggacaacggcccccaaagtcaatgatttangatgtcagtgagccggtccctcgacggggtccctgactcgctttcgtctggctcaagtctgcacnccgcctcccaacactctcgtcggcctccgaggcctaggacggcgtaggcgtactgtaattcgttactgacttcgctctattactcgcgacggtcgaaggttactacgtttgtagttccgggacggacggactaggcgtacggaccgttcgtacggtcacgacccgaggtcccg

SEQ ID NO: 149933 - DNA, 673 bp, Homo sapiens
  misc_feature: GYAE6OF02IFTM6.19.14.B03.1.454.CMB.1.raw
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
  modified_base (425)..(425): a, c, t, g, unknown or other
  misc_feature (425)..(425): n is a, c, g, or t
tcagtactctcgtgcacgaccggtgctcgatttagtgtgagtagttccgcggggggggggttctcaggaggcagcactctcgggacgtctccaccatggccctgggctctgctcctcctcagccctcctcactcaggggcacaggactcctgggctcagtctgccctgactcagccctcactcagtgtccggtctccgtggacagtcagtccaccatcgtcctgcactggaaccngcagtgatggttggtgttataactatgtctcgtgaccaacaacaccagcaacggacccaagtcaatgtatttagngtatgtacagtgacgtccggtccctggacgggtccctgacttcgtcttccgtcgtcggtcctaccgtaagtccgtaggtacctaaaccgtaccggtccctaacccgtaaacccgngttaccgtccgtacgggtaccttccggtaaggtccgtaggaacgggttagtaggaacggtctagttaactttacgttacgtcgtacgttcgtacgtactaagttacgtcggacgtacggaccgtaacgttaccgttacgttttacggtaacggttaccgggaacgggtaaccggtaacgtaccggttaccgttaccggtacccggtaccggttaccggtaccgaaccggtaccccggtagtaccccgg

SEQ ID NO: 149934 - DNA, 712 bp, Homo sapiens
  misc_feature: GYAE6OF02G7KP5.19.14.B03.1.454.CMB.1.raw
  modified_base (347)..(347): a, c, t, g, unknown or other
  misc_feature (347)..(347): n is a, c, g, or t
tcagtactctcgtgcacgaccggtgctcgatttagtgtgagtagttccgcgggggggggggttctcaggaggcagcactctcgggacgtctccaccatggcctgggctctgtctcctcctcagccctcctcactcagggctacgagggatccgtgggactcgaggtcctggccctggactcagccctcactcgagtcggtcccgggtctccgtggactagtcagtccaccatcctccgtgcctacgtacggaacccagcgaggtcgattggttggtaggttataactatcgtctccgtagtaaccaacacaccgaggacaaccggaccccaagtcagtgtatttagngtagtgtcgagtcgacgccggtccgtcgggtccgggtcctgtacgttccgtcttcgtcgtcggtcctacgagttccgtacggaaccaccggtacccgtaccctacccgtaacctcgttccgtcgggtccggacctccggtaaggcgtaagggacgtaggtacggacggttgttaacgttaactttacgttacgtcggtaccgttcgtaccttacgtagtcgtacggaactacggggtacgttaaccgggttacgtttaacgggtttcggttacgggttaccgggggaaccgggtaacggtaccgacgtcggtttaccggtaacccggtgtaaccgggtccaaccggtacccggtacgtcccccgg

SEQ ID NO: 149935 - DNA, 816 bp, Homo sapiens
  misc_feature: GYAE6OF02HDEZN.19.14.B03.1.454.CMB.1.raw
tcagtactctcgtgcacgaccggtgctcgatttagtgtgagtagttccgcgggggggggggtctcaggaggcagcactctcgggacgtctccaccatggcctgggctctgccctcctcagctcctcactcaggcgacagagtcctcggcgtcacgtcgtcgcccgtcgtactacctacgcctcctacctccgtacggttcggttcccggggttccgttcccgttacgggtaccgaacggttcacgtacctacccacttccttccttacgccgaaccgtacggaaccgacgcgagtaggagttggtttgggtttagggtttaattaaacttagttacgttccgttacccgttacgggttaacccaaacaaaccaccccgacgggaccgaaaccggaacccccgtaaaagtacctataaggttattttaacgttacgtacgtacgtcgtaacgggtcggtaacggccggtccccgttacggacgggggttcccgtacgagttcccgtcgttcttccgcggttaccgtaccctaaggttccgtcggaaccgaaacccgtacccggtccctttaacccctaactacgttccttcggtacggtccgtaccgtacggtacgtacgtaggacggttgaacgggtcgttgttaactttacgttacgtacggtcgtaccgtcgtaccgttatagtacgtacgacggtacgtacggttacgttaacgtttcggttacgttcggggccgggtaacgggaacgtacgtacccggacggttacccgtacggtcggtaacccgtcgacccggtacggtccgttaccccgg

SEQ ID NO: 149936 - DNA, 679 bp, Homo sapiens
  misc_feature: GYAE6OF02F97SO.19.14.B03.1.454.CMB.1.raw
  modified_base (93)..(93): a, c, t, g, unknown or other
  misc_feature (93)..(93): n is a, c, g, or t
  modified_base (246)..(246): a, c, t, g, unknown or other
  misc_feature (246)..(246): n is a, c, g, or t
tcagtactctcgtgcacgaccggtgctcgattttagtgtgagtagtttgggtttaggggggggtcacaaggaggcagcgctctcgggacgtcnccaccatggcctgggctctgctgcctcctcactctcctcacgtcaggacacagggtccctgggcccagtcctagtccctgactcagtctgccctccgtgtcgtgggtcctccgtggacacgtccgtcacctatcctcctgcacgtcggaaccngcagtgtattggttacgtaaattccgtaacttgtctaccgtaggtaacccaactactccaaccctaaataaccgaccccctaaatccatactaatttaagtacgtaactacgacccaagtaacggcccgtaccgttacggttacgggtttactaactccggttcctttacgtcgtacggcctaccgtacgtctcggacaaccgaccgtccctccgacgaactacgttcgtcgtacggctcggaggtctagggacgtacgggaggtccttagaactttacgaccgtcgtcgtacgtcctataacttagtacgacggtacgtaacgttaaccgttaacgttcgtttaacggtaacgttagggacggtacgtacgagtccgtacgtaccgtccgtacgtcgacgacgtacggccgccgtccccgtagtacctcccg

SEQ ID NO: 149937 - DNA, 542 bp, Homo sapiens
  misc_feature: GYAE6OF02FYO4O.19.14.B03.1.454.CMB.1.raw
  modified_base (225)..(225): a, c, t, g, unknown or other
  misc_feature (225)..(225): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctcctggacagtcagtcaccatctctgcactggaaccngcagtgagtgttggtgttataactatgtctctgtaccaacaacaccagacaacgccccaaagtcatgtattatgatgtcagtgacgcggcctcgacgggtcctgactcgtcttcgtcgtcgtcctaccgaagttcgtacggaccaaccgacccggcccctaccctaaccacttcctcgtcggctccgagccgtgagagtggagtatgtaattatactgctgacttgatngagngcgtagtacgttgttggtacgtacgggcggtaacggacctaagccgtacgtacccgtcgtacgtcgaccgtaccgagtccccgg

SEQ ID NO: 149938 - DNA, 617 bp, Homo sapiens
  misc_feature: GYAE6OF02FSP4Q.19.14.B03.1.454.CMB.1.raw
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctcctgtaccaacacaccagcaacggccccaagtcatgtattatgatgtcagtgagccggccctcgacgggtccctgactcgtcttctcgtggctccgagtctgacacaccggccctaccctaacctactcctcgtcgggtcctccgaggctaggacggtagtcggacggtcttagtactttatacgtgtccgttcgcttacacgttactcggtacgacgggtacgtaacgggttaccttacggttttagggttacggtttaccggggaaccggggtacgggtaaacccgtaagggtcccgttaacggtacccggttaccggttacgggtaccgacccggtaccccggtaagggtcccccgg

SEQ ID NO: 149939 - DNA, 656 bp, Homo sapiens
  misc_feature: GYAE6OF02FYB52.19.14.B03.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctcctggacngtcagtcacntctcctgcactggaaccagcagtgattggttggtgttatactatgtctcgtcgtacaacaacaccgagacaacggccccaagtcatgtattacgtgatgtcagtcgacggccggtccctacggtacgggtcctggactcgtcttcgtcgtgctaccgagtctcggaccaacgcccgtaccctaccctaacctctctcgtcggtcctccgacgtcgtacggaggtacgtggtacggtcgttagtaaccgtttattaccgtcgtcgttcgtaccttacgtacgttagtcgtaccgtacggtaccgttaacgggttacctttaccggttttacggttacgggttaccggggtaaccggggtaaccgggtaaccgtaacggtaccggttaaccggtacccggttaccggttaacccggtaccggaacccggtaccccgaacgggttcccccgg

SEQ ID NO: 149940 - DNA, 673 bp, Homo sapiens
  misc_feature: GYAE6OF02H2DAG.19.14.B03.1.454.CMB.1.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctcgtggacngtcagtcaccatctcctgcactggaaccagcagtgattggttggtaggttataactagtgtcctcgtacgtaccaacacaccgaggacaaccggccctaaagtcagtgtatttancgatgtacngtcgagccggaccctggacgggtcctgacttcggtacttcgtcgtacggcctacgtaacgtccgtacgaaccgtaaccgccggtaccccttaaccctaactacgttccgtaccggttccgggaccttaccgtcgggtacctgggtaaacggtagttcggaacggttcgttaagtaacttttacgtaaccgtcgtacgttcgtacctacgtattaaacggcgtacgaacggtacgtaacgtttacctaccggttttgggttaacgttccggggaacggtaaccgggtacgtaacggtccgttaccgtacccggtaaccgttcgggaccctacgggaccccgtaggtaccccgg

SEQ ID NO: 149941 - DNA, 630 bp, Homo sapiens
  misc_feature: GYAE6OF02GYP3L.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtgttataactatgtctctggtaccaacaaccaccaggcaacggacccccaaagtcatgtatttatgatgtcagtgacgccggccctacggacgggtccctgactcgtcttctcgtcggtcctaccgtaagtctacggaccaaccgtacccgggaccccttacccctaaccctacttccgtcgtccgggtaccctccgacgggtcctagggacggacgtggacggtctagtattacttactagtctcgtactacgtattagcgtacagggtactaaggtaaccttacggttttaggtacggtttccggggacgggtaacggtaaccgtaagggtccgtaccggtacccggttaccgtaacggtacccgacggtacccgtaacggtccccgg

SEQ ID NO: 149942 - DNA, 673 bp, Homo sapiens
  misc_feature: GYAE6OF02GJ91S.19.14.B03.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatccgtgggctcagtctgccctgactcagcctcactcagtcgtccgggtntcctggacngtcagtcaccatcctcctgcactggaaccngcagtcgattggttggtaggttaataacgtatcgtctcgtcgtaacaacaaccaccgaggaccaacgaccccaaagtcatgtacttatgatgtacaggtcgacgccggtcctacggcggtaccctggactccgtctttcgtaccggtcgtacctaccgtaacgtccgtcggaaccaaccgtcccgggtacccctacccgtaaaccgtcttaccttccgggtaccggcctaccgtaaggcgttaacggaggtcgtacggtaggtccgttagtaacgtttacgtcttacggcgttaccgtacttactacgttacgtcgaacgtagtaccggaacggttacgttacgggtttacgtaacggttccggggtaacggacggaaccggtaacgtaccgttacggtacccgtaccggttacggacgtaccgtacccggacggttccccgg

SEQ ID NO: 149943 - DNA, 645 bp, Homo sapiens
  misc_feature: GYAE6OF02H6QIA.19.14.B03.1.454.CMB.1.raw
  modified_base (175)..(175): a, c, t, g, unknown or other
  misc_feature (175)..(175): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatccgtgggctcagtctcgccctgactcagccctnactcagtcgtccggtctctggacagtcagtccaccatctccgtgacacgtggaaccagcaagtgattggttggtaggtttaataactatcgttctccgtagaaccaacaaccacccgaggacaaccggacccctaaagtcatgtattatgatntacagtgacgccgtccctggtacgggtccngactcgtcgttactcgacggtctaccgtagttcgacggaacctaaccgacccggtcccttaaccctaacnctttccggtccgtccgggcctaccgacggttcgtaacggnggtaacncggtaacggtcttagtaaacgtttctaacgtcgtacgtacgtacctatacgttacgtcgaacgacggtacgtaacgttacgttcgtttaggtacgttacccgggaggtaaccggaactggtaccgtcggtaacctacggttaccgaccgtaacgacccgtaaggtccccg

SEQ ID NO: 149944 - DNA, 810 bp, Homo sapiens
  misc_feature: GYAE6OF02HYEDE.19.14.B03.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (787)..(787): a, c, t, g, unknown or other
  misc_feature (787)..(787): n is a, c, g, or t
tcagtactctcgtgcacgaccggtgctcgatttagtgtgagtagttccgcgggggggggtcgtcaggaggcagcgctctcgggacgtctccaccatggcctgggctctgctgctcctcactctcctcactcaggacacagggtcctgggcccagtctcgccctgactcagtctcgcctccgtgtctgggtctcctggacnggtcggtcaccatctcctgcactggaaccagcagtnatgttaggaattctaacttgtctctgtaacacatcaaccaaataaacgtccccaaactcactactaagtttanagtatcgaccaactaacggaccggtcccttacggtaaggggttttacctaaacgttcccggtacttttcgtaccgtcgggtaccttacccgtaaaggttaccgttcgggaaacctaaacccggtacccggtcccttaccccgtaggtaaacctaacgtttcccgtaccgttcgggggtacccctacccggtaacgggtccgtaacgggaacggggtaaacccggtaggggtaccgttaacggttaaccgtttaaaccttaccggttacgtccgtacgttaccgacttaacggttagtacggtaccgtacggggtttaccttacgttaacccgttttctttacgggttacgtttaccgttaaccgggtaacggttaccggggtaacgtttaaccgggtcccggtaaacccggtttcgttaaaccgggttcccgaaacccgtaccccgggtaaaccccggtaccctaaaacccccggttnttaccccggttaattaaccccgg

SEQ ID NO: 149945 - DNA, 927 bp, Homo sapiens
  misc_feature: GYAE6OF02IAYKD.19.14.B03.1.454.CMB.1.raw
  modified_base (211)..(211): a, c, t, g, unknown or other
  misc_feature (211)..(211): n is a, c, g, or t
tcagtactctcgtgcacgaccggtgctcgatttagtgtgagtagttccggcgggggggggggtctcagggaggcagcactctcgggacgtctccaccatggcctgggctctgctcctcctcagcctcctcactcagggcacgaggatccgtgggctcagtcgtcgccctgactcagcctcactcgacggtcggtccggtcctccgtggacngtacacgtcacctactcctcctcgactacgtacggaaccaggcgtagtgtagttggttaggttaggttaataacgttagttcgtcctaccgtacgtaaccaaactaaacccgaaccgaggaaccgaaccccggaacccctaaagtacctaagttacgttaacgtttaagcgtatgttacgaggtacggaccggtcccggtaccgttcgggtacggggttaccctaggtaaccttccgttccgttccgttaccgtcggtaccctaaccggtacgtaccggttaccggaaccctaacccggtaccccggttccccttaaacccgttaaaccgttcgtttacccggtaccgggttaccgggtaccccgtaaccgggtacggtaccgggtaaaggtacgggttaaccggttacgggaaccgggtttacctttaaagggtttaactttaccggtttacggtaccgtcggttaacgtttacccttaacgttaaaactcggttaccggaaaacgggttccgggttaaaccggttaaggtttaacccgtttacggggttttaccggggtttaaacgggtccccggggggaaaccgggtttaaacggggttaccccgaaaggggtttaccccccggggttaagtttaacccccgggggttaccggttaaacggggttacccccccgggtaaggggttaacccccgaaccggggttttccccccgg

SEQ ID NO: 149946 - DNA, 573 bp, Homo sapiens
  misc_feature: GYAE6OF02GGPEY.19.14.B03.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcaccatctcctgcactggaaccngcagtnatgttggtgttataactatgtctcctggtaccaacaacaccaggcaacggcccccaaagtccatgtaattatgatgtcagtgacgccggccctcgacggggtccctgactccgtcttctcgtcggctccaagtctacggaccaacgccggtccctacccgtaaccactccgtcgtcggcctccgaggtccgtagacggattggacgtcgtgtaattacgttactcgactcgtctacattacgtcgacgtaggcgtaacggtacttacgtttggtacgttcggggcggaacggtaccagtcgtacgaccgttcgtacggtaccacggtcccgaggtcccg

SEQ ID NO: 149947 - DNA, 680 bp, Homo sapiens
  misc_feature: GYAE6OF02I2GCI.19.14.B03.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcgagggcacaggatccgtgggctcagtctgccctgactcagcctcactcagtcgtccgggtctcctggacagtcagtcactatctcctagccactggaaccngcagtnatggttggtagttatactatcgtctctagtaccaacacaccaggacaacggacccaagtctatntatttagngtatcgtcaggtgacgccgtcccgtcgtacgggtccngacgtcgtcttctcgtcgtctaccgagttctcggaccaaaccgtcccggtccctacccgtaacctcttacccgtcggtaccggtacctccggaggtccgtagggtaaggtaggtacggtagtaccgttaagttacctttaactttacggtcgtacgttccgtacttaccggaagtttcgtaccggacgtaacgggtccgtaaacggttccgttaacggttttcgggtaacggtttaccggggaacgggtaaccgggtaaccgtacgttaccggtaacccggttacccggttccggttaaccggccgtaacccggtcccggtaacgttccccgg

SEQ ID NO: 149948 - DNA, 647 bp, Homo sapiens
  misc_feature: GYAE6OF02HD8R2.19.14.B03.1.454.CMB.1.raw
  modified_base (234)..(234): a, c, t, g, unknown or other
  misc_feature (234)..(234): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtcgtccgggtctccgtggacagtcagtccaccatcctcctgaccactcggaaccngcagtgtatggttggtagttataatatgtctcgtgtaccaacacaccaggacaaccgacccaaagtcatgtatttatgatgtacgagtaggacgccggtcctcggtacgggtcctgactcgtcttctcgtcgctacgtacgtcgtcggaccaacgccggtacccctaccctaaccgtaccttccgttacgtccgggtacccttaccgaggtaccgtaggacggtaacgtaggacggtcgtagttacgtttacgttaccgtcgtcgtaggtaccttatacgttgcgtaacggtcggtacgtacgttacgttacgtttagggttccgttacggggcgggtaaccggacgtaacggtcccgtacggtacccgttaccggtacgtacccggaccggtacccggtacgttacccccgg

SEQ ID NO: 149949 - DNA, 713 bp, Homo sapiens
  misc_feature: GYAE6OF02FUZR5.19.14.B03.1.454.CMB.1.raw
tcagtactctcgtgcacgaccggtgctcgatttagtgtgagtagttccgcggggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactcggaaccagcagtgactggttggtggttatactatgtctctggtaccaacaacaccagcaacggccccaaagtcatgattatgatgtcagtgacgcgtcccgtcgtacggggtccctgacgtcgtcttctcttcggccttccgaagttccgtacggaccctaaaccgtacccgggaccccttacccctaaaccctacgttcccgttacgtccggggtcccttacccggacggtacccgttagggaaccggtatacgggacggtcttaacgttaagttttaccttaaccgttcggtcgtaccggtaccttaccgtaacttaacgtgtaccgaaccggtacgttaacgggttaacctaccgggtttttagggtaaccgtttccggggaacggggttaaaccgggaaccgtaacccgggtacgtttaaccgggaccccggtttacccggttacgggtaacccgtacccggtaaccccggaagggttccccccgg

SEQ ID NO: 149950 - DNA, 756 bp, Homo sapiens
  misc_feature: GYAE6OF02I0RIC.19.14.B03.1.454.CMB.1.raw
  modified_base (207)..(207): a, c, t, g, unknown or other
  misc_feature (207)..(207): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcgagggcacgaggatccgtggctcgagtctcgccctgactcacgcctcactcgaggtcggtccggtctccgtaggacngtcagtcactatcctcctgcacgtacggaaccagcgagtgatggttggtagttataatatgtctacgtacgtaaccaacaccaccgagaccgtaaccggacccctaagtacgtatacgtattagtagtacgtcgtacgtacgtagcggtccgtaccggtacggtaccgggtacctgtacgtcgtcgttcgtcgtacgtacgtaccgtaacgtcgtacgaaccgaccgtccgtacccgtaccctaacgtcgtccgtcgtaccggtcgtaccggtacggtccgtaggaacgtacggtacggtaccggtacgttacgttaacgttaccgttccgtacggtccgtcgtacgttaccgtaagttaccgtacgggtccggtaacggttaacggttaacgggtttaaccttttacggggttaccgggttacggttaaccgggggtaaccggtaccgggtaaaccggttaccgggtacccggtttaaccggtaacccgggtttacccggtaaacgggttcccggaaaaccggtccccgggtacggttaccccccggg

SEQ ID NO: 149951 - DNA, 644 bp, Homo sapiens
  misc_feature: GYAE6OF02IS1VK.19.14.B03.1.454.CMB.1.raw
  modified_base (352)..(352): a, c, t, g, unknown or other
  misc_feature (352)..(352): n is a, c, g, or t
  modified_base (468)..(468): a, c, t, g, unknown or other
  misc_feature (468)..(468): n is a, c, g, or t
  modified_base (522)..(522): a, c, t, g, unknown or other
  misc_feature (522)..(522): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatccgtgggctcagtctgccctgactcagcctcactcagtcgtccggtctcgtggacagtcagtccaccatctcctgcctacgtacggaaaccagcgagttgtagttggtttggttaggtttaattaaccgttagttcgtccttccgtacggtaaaccaaccaaaccacccgaggaccaaccggaaccccaagtcaagttagttatttanagtatgtacgagtagacggccgtaccgtacggtacgggtcctagtacgtcgtcttcgtcgtcgacctacgtaacgtcaacgacctaaccgtaccgacccttaccgaactcgttacncggtcggtcctcgagtcgtaggtaggagttcggacgttacgtattaattacgtncggtgtcgactacgtaatagtcggtacgaggtcgtaaaggtcgttaggttgacggtacgggtaggaacggtacgtaacggtcgtacggtaccgtacgtacggaccgtacgaccgtagtcccg

SEQ ID NO: 149952 - DNA, 661 bp, Homo sapiens
  misc_feature: GYAE6OF02ICAO8.19.14.B03.1.454.CMB.1.raw
  modified_base (205)..(205): a, c, t, g, unknown or other
  misc_feature (205)..(205): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (510)..(510): a, c, t, g, unknown or other
  misc_feature (510)..(510): n is a, c, g, or t
  modified_base (555)..(555): a, c, t, g, unknown or other
  misc_feature (555)..(555): n is a, c, g, or t
tcagtactctcgtgcacgaccggtgctcgatttagtgtgagtagtttggggtttagggggggggtcacaagaggcagcgctctcgggacgtctccaccatggcctgggctctgctgctcctcactctcctcactcaggacacgagggtcctgggcccagtctcgccctgactcagtctgcctcgtgtctcgggtctacctggacnggtccggtcaccatcctccgtagctacgtcggaccagtcagtcgattgttaggaaattctaaccgttgtcctctacggtaccaacatcctaaccaaaataacgccccaatcatctagttangangactaactaagccggtacctagtacggggtttacctaagtccgtacttcgtactcggacttacgaagttccgagacaaacgcccgacctccctaagacttaactccgttacgcgggtaccttcccgaaggttcggacggaagggtacgcggtaccttaggaactttaccgaagttgcgttntactactattacgttcgacgttagggtactaacgtctttaacttntacggttccgttaacgggaaccttacgggaacccgtaggtaccctaaccgtcggtaccggttaccgacgtacccgaaccgccctaaacgcgttcggtaccttaccg

SEQ ID NO: 149953 - DNA, 679 bp, Homo sapiens
  misc_feature: GYAE6OF02GUXHI.19.14.B03.1.454.CMB.1.raw
  modified_base (301)..(301): a, c, t, g, unknown or other
  misc_feature (301)..(301): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtcgtccgggtctcctggacagtcagtccaccatctcctgcacgtggaaccagcagtgatgttggtagttataactatgtctctgtaccaacaacaccagcaaggccccaagcatgacttangatgtcagtgacgcggccctgacgggtcctgacgtcgtcttcgtcgtggtcctaccgtaacgtcgtcggaccaaaccgtaccgggtaccccttacccgtaacctactcccgtaccggtcgggcctacccgtaggccgtaggaacggtacgtggaacggtctacggttaatttaacgttacgtacggtccgttagtaccgtacctagttaacttcggacgtaacggtccgttaaacgggttaccgttacggttttacgggttaccggttaccggggaccggggtaaccgggtaacccgtaaacggttaccggttaccggtaacccggtttaccggtaacggtaccggtaaccggtaaccccggtacggttaacccccgg

SEQ ID NO: 149954 - DNA, 677 bp, Homo sapiens
  misc_feature: GYAE6OF02ILQ0C.19.14.B03.1.454.CMB.1.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (332)..(332): a, c, t, g, unknown or other
  misc_feature (332)..(332): n is a, c, g, or t
  modified_base (510)..(510): a, c, t, g, unknown or other
  misc_feature (510)..(510): n is a, c, g, or t
tcagtactctcgtgcacgaccggtgctcgatttagtgtgagtagttccgcgggggggggtcgtcaggaggcagcactctcgggacgtctccaccatggcctgggctctgctcctctcagcctctcactcagggcacgaggtactccgtgggctccagtctgccctgactcagcctnactcgagtcgccgggtntcgtaggcagtcagtcactnctcctagcaacgtggaaccagctagngatcgttgngttatacgtctgtctactagtaccaacacgaccgagacgacgaccctaagtccaattgacttacgtggacttggactaggtcgngtccggccttggacgggtcctagcgtcgtcttacgtactacggtcctacgtacggtctacggtaacctaccggtaccgtcccgtaacctaaccgagttcccgttcgcggggtaccttacccgaggtcttaccgggaggtacgtagggtctaccgggttatacgtttaacgtcggaccngtttaaccgcttacgtagtaccgttcggaaggaccgttaggccgttttaaacgtacgggttacccgtaaaggttccggaacccggttaacggggaacctttacggaacccgttaccgtaccggtaccgttaccggaccccgtttagaccccggtagttacccccggg

SEQ ID NO: 149955 - DNA, 650 bp, Homo sapiens
  misc_feature: GYAE6OF02F7JIR.19.14.B03.1.454.CMB.1.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctggctcagtctgccctgactcagcctcactcagtcgtccggtntccgtggacagtcagtccaccntccgtcctgcacgtggaaccngcagtgatgttaggtgttatactatgtctctgtaaccaacaacaccagacaacgccccaaagtcatacgatttangnttgcaggtgacgccgtccncgacgggtctgactcgtcttcncgtgctacagtctacggactaaccgaccggtccctaccgtaaacctctcgtacgtaccgggtctaccggtacgtactacggaggacttgggtaacggtcgttagtactttaacgttacgtgaacgttcgacgttaccaagttccgtacggacttaccgggtataaccggttacgttacggttttacggtacggttacccgggtacgggttaaccggaacttaaccgggtcccgttaacggtaccccggttacggtttaaccgggcccgtaacccggggtaccccttacgggggttcccccg

SEQ ID NO: 149956 - DNA, 731 bp, Homo sapiens
  misc_feature: GYAE6OF02IJDN5.19.14.B03.1.454.CMB.1.raw
  modified_base (140)..(140): a, c, t, g, unknown or other
  misc_feature (140)..(140): n is a, c, g, or t
  modified_base (218)..(218): a, c, t, g, unknown or other
  misc_feature (218)..(218): n is a, c, g, or t
tcagtactctcgtgcacgaccggtgctcgatttagtgtgagtagttccgcggggggggtctcaggaggcagcactctcgggacgtctccaccatggcctgggctctgctcctcctcagcctcctcactcagggcacaggntccgtgggctcgagtctcgccctgactcacgcctcaactcgtagtcggtccggtctccgtaggacagtcagtccaacntcctctcgacacgtacggaacagctaagtgtagttggttcggttaggttaataacgttatcgtacctcgtacgtaaccgaaacaccaccgaggaccacggaacccctaagtcaattacgtattagagtatcggtactaggtcgacggacccgtccgtacggaccgggtttccagttaccgtcgtcttcgcgtcgtaccttacgtagtaccgtcggaacccgtacgtacccgtaccctaccctaacgtacgttccgtaaccggtcgtcccggtactacgggcttacgggtagacgtcggtacgtcgttagttacgttaacttcggcgtcgttacggtaccttacgtacgttacgtacggtaccgtaaggtaacccgtacggttaacctttagggtttaccggttaccgggtttaccggggaacggttaacgggaccctaacgggtccgtacccgggttaccggtaccggttaccggttaaccgggaacccgtacccggggaacgttcccccggg

SEQ ID NO: 149957 - DNA, 604 bp, Homo sapiens
  misc_feature: GYAE6OF02FU5WD.19.14.B03.1.454.CMB.1.raw
  modified_base (228)..(228): a, c, t, g, unknown or other
  misc_feature (228)..(228): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatccgtgggctcagtctgccctgactcagcctcactcagtcgtccgggtctctggacagtcagtcactatctctgcactggaaccngcagtcgagttggttggtagttactaactatgtcctccgtaggtaaccaacaacaccgagaccaacggaccccaaagtcatagtattacngattgcagtgacgccgccgtcgacgggtcctgactcgtctctcgtcgactcagtcngaccacgaccgcctacctactcttcgtacgcggtactccgagtcgtaggaggtagnggtacgtcgtagttaagtttactacgtcgtctcgtacgtatagtacgtcgcgaaggtaccgtaacggttactaggtttcgggtaacgttaccgggggacggtaaccgggtactaacggtccgtaacgtacccgggttacggtaccgttaccggaccgtacccgagggtcccccg

SEQ ID NO: 149958 - DNA, 639 bp, Homo sapiens
  misc_feature: GYAE6OF02JYJBR.19.14.B03.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
tcagtactctcgtgcacgaccggtgctcgatttagtgtgagtagttccgcgggggggggtctcaggaggcagcactctcgggacgtctccaccatggcctgggctctgctccgtcctcagcctcctcactcagggcacaggatcctgggctcagtctgccctgaactcagcctcactnacgtgtcccgggtntccgtggaacacggttnacgttccaactgtcctccgtgacgacctggaacccaggcagttgatggttaggtaggtatactatcgtctctaggtaccaacacacctggacacggtaccccaaagtcatgtactttagcggtancgtacagtagacggtccggcccacgtacggggtccctgtacgtccgtacgttctcgtcggtacncctaaggtcgtgaaccacncggtaccctaccaacctntaccgtgtacgcgttaccgcgcttacgggagtgtccgtaaggcgtactaacgttattcgcggttctggtcaccgttagaacgttccgaagttaccgacggtaacggtcctttaccggtaggttacggtttaccgggagggttaccggataaccgtcggtaccgacccggttacggtactacggaccgttacccgaggttccccg

SEQ ID NO: 149959 - DNA, 717 bp, Homo sapiens
  misc_feature: GYAE6OF02JS1VO.19.14.B03.1.454.CMB.1.raw
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (517)..(517): a, c, t, g, unknown or other
  misc_feature (517)..(517): n is a, c, g, or t
tcagtactctcgtgcacgaccggtgctcgatttagtgtgagtagttccgcgggggggtcgtcaggaggcagcactctcgggacgtctccaccatggcctgggctctgctcctcctcagcctcctcactcagggcacaggatccgtgggactcaggtctcgcccgtgactcagcctcactcngtcgtccgggtctccgnggtaccagttcacgtcaaccnttctccngaccacgttaggaaccngcaagtgatgttggttagtatatatgttcgtccttaggtaccaaacaacctaacccgacgacgaaccgaccccgtaaagtacctagttacgtattaacgtgtacgtcgtacgtaggaggtacggtccggtaccgtcggaccggggttacctcgtacgtccgtacttccgttaccgtacggtcgtaccgtaacggtcgtaggtacctaaaccggccggttacccctaccgaaccgtactcgtacgttcggacctcgaacggtcgtaggagtacgnggacgtctaggtgttaactagtcgtacgttcgtaaccgttcgttaagccgttacgttacgaccgggtacttaccgggtttaacgtacggtttcggttaacggtccgggtaacgggtaaaccgggttacgtaaaccggttccgtaaccggtacccgtttacggacccgggtttacctaaccgggaccgtaacggtccccgg

SEQ ID NO: 149960 - DNA, 549 bp, Homo sapiens
  misc_feature: GYAE6OF02GYVJR.19.14.B03.1.454.CMB.1.raw
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatggttggtagttataactntgtctctagtaccaacacaccaggcaacggccccaaagtcatgtattangtatgtnagtgagccggtccctcgtacgggtcctgactcgtcttctcgtcgctcgagtcngacacncgcctaccactctctcgcgtccncgagctggacgntaggcgctgtattntacgtgctgactgtatagtcgacgtggtacgtaacggtacgttaggtttcggttacggtcggggaacgggtaaccggaaccgtagtaccggtacgtacccgttcgtaggacccacggtacccgagtccccgg

SEQ ID NO: 149961 - DNA, 612 bp, Homo sapiens
  misc_feature: GYAE6OF02H22BR.19.14.B03.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (441)..(441): a, c, t, g, unknown or other
  misc_feature (441)..(441): n is a, c, g, or t
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacngtcagtcaccatctctgcactggaaccngcagtgatgttggtggttataactatgtctcctggtaccaanacacacaggacaaggcccccaaaagtcatgatttatnatgtnagtgagcggcctcgtagggtccctgatcgcttctcgtggctacgaagtctaggccaacgccggtccctaccctaacctacttccgtacgtcgggtactcccgaaggtcctggtaacggactggtaacgggtnttacggaatttaagtacttcggctacgtcctactagttaacgtgaccgaaggtccgtaacgggtaccttacgttttcgggttaccgtcgggttaccgggacggggtaaccctaaggtaccgttacggacccgggttccgttacgggttacccaccggtaccccgtaacggg

SEQ ID NO: 149962 - DNA, 611 bp, Homo sapiens
  misc_feature: GYAE6OF02IPTTX.19.14.B03.1.454.CMB.1.raw
  modified_base (259)..(259): a, c, t, g, unknown or other
  misc_feature (259)..(259): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtccaccatcctcctgcacgtggaaccagcagtgatggttggtagttataactatntctctgtacaacacaccagcaacgacccaagtcatgtattatgatgtcagtgagtccggcctcggacgggtcctgtactcgtcttctcgtcgctaccgtagtcgtacggaccaaccgaccggtccctaccctaacctactcgtcgtcgggtcctccgacggcgtaggaacggagtggacggtctagtaatttacttacgtacgtcgtcgtcttacatacgtgacgtacggtacgtaacgttaccgttagtttacgggttacggttacggggacgggaacgggtaccgtaaggtcccgtacggtaacccggttcggttaccggtacggtaaccgacccggtaaggtcccccgg

SEQ ID NO: 149963 - DNA, 879 bp, Homo sapiens
  misc_feature: GYAE6OF02HNMPA.19.14.B03.1.454.CMB.1.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
tcagtactctcgtgcacgaccggtgctcgatttagtgtgagtagttccggcggggggggggggtctcaggaggcagcactctcgggacgtctccaccatggcctgggctctgctcctcctcagcctctcactcagggcacaggatccgtgggctcagtctgcctgactcagcctcactcgagtcggtccggtctccgnggacagtcacgtcacatcnctgcacgtacggaaccagctagngtgttggttggttagttactaagttattcgtctccgtacggtaaccaaccaaacctaacccgagggaaccaaccggaaccccctaaaggtacctaaggttagttaacttttagtacgtaacgttacggtacgtaacggttcggaacgggtcccgggttaccccgtttacggggtaacccgggggtttcccgtaggttaccccttccggtttaccgtttcccgttacggtttaccggtcccttaaccggtaacggtttcccgtaacggaccaaaccccggttaccccggtacccttaaccccgttaacctacgttttccggtaccgggtttcccgaacccgttcccggacgggtacgttacggtaacggacggtttacggaacgggttagttacggttaacgttttaacccttggacccgttgtaccggttacttaccggtaattaccggtacgtaccgggttaaacggtccgggtttaaacccgtttacgttacggggtttaccgggttttaccgggaccccgggggtaaagggtaaccccgttaaggtaaccccgggttaccgtaaccccgggtttaccgacccggggtttaacccggaccggtaaaccccggggtttcccacccggggttaccccgg

SEQ ID NO: 149964 - DNA, 741 bp, Homo sapiens
  misc_feature: GYAE6OF02HPWXZ.19.14.B03.1.454.CMB.1.raw
tcagtactctcgtgcacgaccggtgctcgatttagtgtgagtagttccggcgggggggggggtctcaggaggcagcactctcgggacgtctccaccatggcctgggctctgctcctcctcagcctcctcactcagggcacaggatccgtgggctcagtctcgccctgactcagcctcactcagtcgtccgggtctccgtaggactagtcagtccaccatctcctgccacgtacggaaccagacagtgagttggttaggttaggtttaactaacgtagttcgtaccttcgtacggtaaccaaacaaccgaaccaacggaccaaaaccggtaccccctaaaaggtccaagttacgtaagtttagtacgtagttacgtacgtaggttacggaacggtcccggtaccccgttaccggaaccggggttaccctacggtaccttccgttccgtttccttccggttaacggtaccctaccgtaacggtccgtacggaaccctaaaccgtacccggtacccttaaccctaacgtaccgttccgtaccgtcgggccctaccgacggtacgtaggaaggtcgttaaggacggtcttaaggttacttaagttaccgtcggtactcgttaccgtacttagtaacgtgtacggacggttacgtaacgttacgttcgtttaggtaccgtcggggaacggtacggtaacaaggtccgtacgtaccgttacgacgtccgaacgtaccgaaggtcccg

SEQ ID NO: 149965 - DNA, 741 bp, Homo sapiens
  misc_feature: GYAE6OF02GPICQ.19.14.B03.1.454.CMB.1.raw
tcagtactctcgtgcacgaccggtgctcgatttagtgtgagtagttccggcgggggggggggtctcaggaggcagcactctcgggacgtctccaccatggcctgggctctgctcctcctcagcctcctcactcgagggcacaggatccgtgggctcagtctcgccctgactcagcctacactcagtgtccgggtctccgtggacagtcacgtcacatcctcctagcacgtcggaaccagccaggtgagttggttaggtaggtttaataacttagtacggttcctaccgttacggtaaccaaaccgaaacccacccgaacggaccgaaaccggacccccaaaaggtaccaagttacgtaatttacgtagtaagtcgtactaggtcgacggccggtcccgtaccggtacgggtccctaggtaacgttccgtcgtttcgtcggtcggtaccgtacctaacggttcgtacgacccgtaaccgaacccgggtacccttaaccccgtaacccttaccgtccttaccggtccgggtacctacccgaggtacgtaccggtaggtacgtacgggtacgtcgtaggttacgttaacttcgtcgtctacgtactactagtagtgtaccgaggactaaccgggttacttacggtttcggttacggtaccggggtcggtaaccgggtaccgtaacggtcggtaccgttacccggtacggtaccgggtaccacgggtacccgaggttacccccgg

SEQ ID NO: 149966 - DNA, 670 bp, Homo sapiens
  misc_feature: GYAE6OF02IA099.19.14.B03.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (375)..(375): a, c, t, g, unknown or other
  misc_feature (375)..(375): n is a, c, g, or t
  modified_base (513)..(513): a, c, t, g, unknown or other
  misc_feature (513)..(513): n is a, c, g, or t
tcagtactctcgtgcacgaccggtgctcgatttagtgtgagtagttccgcgggggggggtcgtcaggaggcagcactctcgggacgtctccaccatggcctgggctctgctcctcctcagcctcctcactcagggcacaggatcctgggctcagtctcgccctgactcacgcctcactcagtcgtccggtctcnggacagtcagtcacntcgtctgcactggaaccagcagtgatggttggtagttataactatcgtctacgtgtacaacaacaccaggacaacggacccctaaagtcatagtactttagtgtaatgtcagtacggtacgccggtccgtcggaacgggtccttagacgttcgtccttcgttaccncgggtacctacgtaacgttcgtacggactaaccgaccggtcccctaacctaaacgtcttccgtcggttcggcccttacggaacggcgttaggaacggtagtacgggacggtccttaagtaccgttaattacgcgtacncggtaactcgaaattcgtacgacgacggacgttaaacggtacgttcgtttaggtacgttaccggggagggtaacccggtaactaacgggtacccgttaccggtaaccggtaccggttaacggttaccggaaccggttacccggaacggttcccccgg

SEQ ID NO: 149967 - DNA, 722 bp, Homo sapiens
  misc_feature: GYAE6OF02FOL7F.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcaccatctcctgcactggaaccagcagtgattggttggtagttataacgtatgtctccgtagtaccaacaaccacccgaggaccaacggccccaaagtcaactgtatttatgtattgtacgagtcgacggtaccggtcccctacggaccggggttccctaggtacgttccgtactttccgtccgtcggtcccttaccgtaacgtccgtacgggacctaaacccggtacccggtaccccttacccctaaacccgtacgtttacccgtcggttacgggtccctacccggacggtaccgtaggacgggtagtagggacggtccgttagtaaccttttagttccgtacgtcttcggtaccttagtaacgttacggtcgtaccggacggtacgtaaccgttacgtttacggtttagggtaccggttaccggggaacgggtaaccggaaccgtaacgaccgttaaccggtacccgttaccgttaacgtcccggaacccgttacccggtaaccggttccccccg

SEQ ID NO: 149968 - DNA, 607 bp, Homo sapiens
  misc_feature: GYAE6OF02F7LT8.19.14.B03.1.454.CMB.1.raw
  modified_base (152)..(152): a, c, t, g, unknown or other
  misc_feature (152)..(152): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctnagtctgccctgactcagcctcactcagtgtccgggtctcctggacagtcagtcaccatctcctgcactggaaccagcagtgatgttggtgttataactatgtctctagtaccaacaaccaccagcaacgaccccaaagcatgtattatgatgtcagtgacgccgcctcgacgggtccctgactcgtcttctcgtgcctacgaacgtctacggacaaccgtaccggtccctacccgtaaccactctaccgtgggcctaccggacgtcgtaggaggtacgtgggaacggtcgttagtaatttacgttaccgtacgtcgtcgtcttacctattacgtcgtacgaacggtacgtaacggtacttacggtttaggtacgtttaccggggacgggtaacggaacccgtaagtccgtaacggtacccggttcggtacggtccgaccgacccgtacggtcccg

SEQ ID NO: 149969 - DNA, 598 bp, Homo sapiens
  misc_feature: GYAE6OF02GU46B.19.14.B03.1.454.CMB.1.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
  modified_base (462)..(462): a, c, t, g, unknown or other
  misc_feature (462)..(462): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatcctcctgcactggaaccngcagtgatgttggtagttataactatgtctcctggtaccaacaacaccagcaacgccccaaagcatgattangatgtnagtgagcggccctcgcggggtcctgtatccgcttctcgtcggtctcgaagtcgnggaccaacgaccggccctacccgtaaccactctcgtcgggtctccgaggtctggagagtggaggcttagtattaacttacgtgtccttagcttactaaactntaggacggaacggtacgtaacggttaacttacggtttaggttacgttaccgggacggggaacggtaaccgtaacggccgtacggtaaccccggttcggttaaccggtacctaccggaccccggtagtaccccccgg

SEQ ID NO: 149970 - DNA, 656 bp, Homo sapiens
  misc_feature: GYAE6OF02I0157.19.14.B03.1.454.CMB.1.raw
  modified_base (245)..(245): a, c, t, g, unknown or other
  misc_feature (245)..(245): n is a, c, g, or t
  modified_base (524)..(524): a, c, t, g, unknown or other
  misc_feature (524)..(524): n is a, c, g, or t
tcagtactctcgtgcacgaccggtgctcgatttagtgtgagtagttccggcgggggggggggtctcaggaggcagcactctcgggacgtctccaccatggcctgggctctgctcctcctcagccctcctcactcgagggcacgaggatccgtgggctcgagtctgccctgactcagcctcactcagtggttcccgggtctccgtaggacagtcagtcacctactcctcctgcacgtacggaaccngctagtgtagttggttgggtagtttaatattagtcgtctccgtacggtaaccaaacaaccaccgaggaccaaccggacccaagtcagtagtattatgtattgtacgagtcggacgtccgtccgtacggaccgggtcctagtacgtccgttcttccttcggtcggtacctacgtaagttccgtacggaccaaccgtcccgacctaccctactcctaccgtcgtaccggcgtacgtggcgtggaaggtcgtaggacgtcgtagttacttacgttcgagtcntaccgtatacgtagtcgacgtcgtaacgtcgttaacgttgtttacgggtacgtccggggtggaaccggtaacgccggtaccgtccggtaaccggtcggttaaccggccgtaaccggtaccgaccggtcccgg

SEQ ID NO: 149971 - DNA, 691 bp, Homo sapiens
  misc_feature: GYAE6OF02GHSUI.19.14.B03.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatcctcctgccactggaacccngccagtgatggttggtaggttataactatgtctctaggtaccaacaacaccaggcaacgaccccaaagtcatntattacngtaatgtcagtgagccggtccctgacgggtcctgactcgtcttctcgtggacctaccgaagttccgtacggaccaacccggtacccggtccccttaccccgtaaacctactccgtccggtccgggtcctacccgaggtccgtaggacggtagtcggacggtacttagtaactttacttaccgtgttaccttcggaccttacgtaaacgtttcgacggtaccgaacggtaccggtaaacggtttaccttaacggtttttcgggtaaccggttaccgggggtaacccgggtaacggggtaaaccctaacgggttacccgtaccggtaccccggtttacggtaaccgggttacccgtaaccgacccggttaaccggtcccccgg

SEQ ID NO: 149972 - DNA, 710 bp, Homo sapiens
  misc_feature: GYAE6OF02GQKHG.19.14.B03.1.454.CMB.1.raw
  modified_base (235)..(235): a, c, t, g, unknown or other
  misc_feature (235)..(235): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagccctcctcactcagggcacaggatccgtgggctcagtctgccctgactcagcctcactcagtcgtccgggtctcctggacagtcagtccaccatcctcctgcactcggaaaccngcaggtgtagtggtttagggttaggttaataacttagttgtaccgtccgtacggtaacccaaacaacccacccgacggtacgaaccggtacccccaaaggtcctagttacgtaatttagtacgaattgtacctaaggttcggacggtccccggtccccgtacggtccggggttccctaggtctaccgtcgttccgtcgtcgtccgtacctacgtcgtacggaccaaccggtacccgtaccccttacccgaacccttctaccgttccggtccgggtactaccccggtacggtcgaacgggtacggtagtcggtaacggtcttaagttaaccgtttaacgtacgttcgtacgttataccgttatacgtaagtcggacgtacgtacgtaggttaccttaggttcgtacgggtacgggacggacccggtacggacgtcggaccgtaccggtcgtaccgccggacgccgtacgtccccgg

SEQ ID NO: 149973 - DNA, 781 bp, Homo sapiens
  misc_feature: GYAE6OF02HFCLB.19.14.B03.1.454.CMB.1.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (388)..(388): a, c, t, g, unknown or other
  misc_feature (388)..(388): n is a, c, g, or t
  modified_base (644)..(644): a, c, t, g, unknown or other
  misc_feature (644)..(644): n is a, c, g, or t
tcagtactctcgtgcacgaccggtgctcgatttagtgtgagtagttccgcggggggggggtctcaggaggcagcactctcgggacgtctccaccatggcctgggctctgctcctctcagcctcctcactcagggcaacgaggactccgtgggcctcaggtctcgccctgactcacgcctcactcgtagtcggtccggtctcgtggacagtcagtccacntcctacgngccacgtcggaaaccngacgttaggtgtaggttcgggtttaggttaacggtttaataacgtcgttcgttacctacgtaaccgtaaccaaaccaacccgaaccggtacgaaccgtaaacccggacccaagtctagttacgttaattacgtatagttcgtagnggtacgtaccggtcccgtaccggtacgggtaccgggtacctacgtaccgttccgttaccgtttccggtacgtacgtaccgttaccgtaacggtcgtaccgggaacccgtaacccgtacccggttacccctaaacccgttaccgttaccgtccgttaccggtaccgggtacccgtaccggaggtcggtaacggaaggtacggtacgggttacggtacgttacgttaacgtttacgtacgtcgttacgtcgtacttanagttacgaccggtacgtacggtacggttaacgttcgttacgggttggtaccgggtacgggaacggtaacggaaccgtacggtaccggttaccggttacgtaccggaccggttaccggaccgttacggccggtcccgg

SEQ ID NO: 149974 - DNA, 726 bp, Homo sapiens
  misc_feature: GYAE6OF02I7485.19.14.B03.1.454.CMB.1.raw
  modified_base (169)..(169): a, c, t, g, unknown or other
  misc_feature (169)..(169): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatccgtgggctcagtctcgccctgactnacgcctcactcagtcgtccgggtctcgtggacagtcagtccacntcctctgcacgtcggaccngcaggtacgagttggttggtaggttactacgtatcgttcctccgtacgaaccaactaaccaccgacgtacgaacccggacccctaaagtctagtacgtactttagacgtacgtgtacgtacgtcgacggtcccggtccgcggttaaccgggttcctgtacttccggtctttacccgcggttacgtaccgtacgtaaccgtcggtaccgtaacgaacccgtcccgtaccccttaacccgtaactacgttccgtaacggtcccgtaactccgtaggttccgtaaggcgtagtacggtaccgtacgttagttaacttacgttaccgtcggacgttaccggtctttaacgtacgttacgttacgaaccggtacggtacggttaaccggtacgttttcggttacggttcggacccggggtaacgggaccggtaaccgtacggtccggttaacggtacccgttacggtacgggacctacccgacggttacccgtacccgg

SEQ ID NO: 149975 - DNA, 720 bp, Homo sapiens
  misc_feature: GYAE6OF02IVCDY.19.14.B03.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (518)..(518): a, c, t, g, unknown or other
  misc_feature (518)..(518): n is a, c, g, or t
  modified_base (550)..(550): a, c, t, g, unknown or other
  misc_feature (550)..(550): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatccgtgggctcgagtctgccctgactcagcctcactcagtgtccgggtctcctggacngtcacgtcacatcctccgtgacacgtcggaaccngcagtcgattggttggttacgttaataacgtatcgttccgtccgtacggtaacccaaacctaaccgaacccgacggtaccgaaacccggtacccccccgaaaaagttccgtaaagttacggtttaacctttttaaggtacgttaacggtttcgttaccgtaagggttagggaccggtacccgggtaccccgttacggtaccggggttccctaggttacgttccgtccgtttctcgtcggtacctaccgtacgtcgtacgacctaccgacgtccctacctaaccntccgtcgtcggccacgtacgtcgtacggtagngtaggtcgtgtattattacgtcgtgtcgttacgtctagtactagttacgacgtagtacgtacggtaacgtttcggtaggttaccgttcggggaaccgggtacggaccggtacgtaccggttacacccggttacgttaccgccggtaacccggtaccgaccggttccccgg

SEQ ID NO: 149976 - DNA, 782 bp, Homo sapiens
  misc_feature: GYAE6OF02FPO3H.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatccgtgggctcagtctgccctgactcagcctcactcagtcgtccgggtctccgtggacagtcagtcaccatcctctgcactcggaaccagcagtgtagttggttgggtagttaataacgttatcgttctaccgtaggtaaccaaaccaacccgacccgaaggacccaaccggaccccctaaaagtcctaagtacgttaacgtttagagtattacggtactaaggtcggaaccggtcccggtaccccggtacggtaaccggggttccctacggttaccgttccgtcgtttccgttacggtcggtacccttaccgtaaacggttccgtaccgggtaacccgaacccggtaaccccgggtccccttaaccccgtaaacccgttcgtacccgtttccggtaccgggttccccgtaccggtacggtaccgttaggaacggtgtaacggtcgttacgttagttaactttacttacgtcgttcgtactaccgttactagtacgtacgaccggtaacggtaccgttacggttaaccgtttaggtttacgggtacggttacccggggaacgggaaccgggtaaccgtacggtaccgttaaccggtacccggttacgtaccggaccgaccggtacccggtcgttccccgg

SEQ ID NO: 149977 - DNA, 603 bp, Homo sapiens
  misc_feature: GYAE6OF02H3OVP.19.14.B03.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (410)..(410): a, c, t, g, unknown or other
  misc_feature (410)..(410): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (501)..(501): a, c, t, g, unknown or other
  misc_feature (501)..(501): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggactcagtctgccctgactcagcctcactcagtgccggtctcnggacngtcagtcactatctctgcactggaaccagcagtgatggttggtagttataactnttacgtctcctagtaaccaacgacacccgaggcctaaccggacccaagcatcgtattactgatgtcagtgacgtccggcctcggacgggtacctgactccgtcttcgtcgtggcctactactacgtggacctacgtacccgggtcccttacccaaccgtntcccgtcgttccggctcggacgttccgagnggtaacgtggtaaccgtntaagttagttactaccgnttcgtntaccgtatgtacgcgacgngtactagtagtccgtttaggtcgtaccgggtcggaacggttaccaacggtccgtacggtacccgttacgtaacggtctaaaccggccgtaccggttacccgg

SEQ ID NO: 149978 - DNA, 697 bp, Homo sapiens
  misc_feature: GYAE6OF02GOSOA.19.14.B03.1.454.CMB.1.raw
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctcgccctgactcagcctcactcagtcgtccgggtctccgtggacagtcagtcaccatcctcctgcactaggaaccagcagtgtagttggttggttagttataacttatcgtctccgtacgtaaccaacaaccgacccgaggaccgaacccgaacccctaaagtacctagttacgttatttaacgtagtagttacggtacgtaacggtcggaccggtccccgggtccccggtacggttacccggggtcctaggtaccgttccggttaccttcgtccggtacggtaccctacggtacgtcgtacggacctaaccggtacccgtaccccttaacccgtaacctcgtcccgtcgggtccgtccgtaccggtcggtacgtaggacggtacgtaggtacgtcgttaacgttaacttctacggtctcgtctactctaagtcgcgtacgacgtacgaacgttacgttaggttcgtacgggtcggaacgggaccgtacgacgtaccgtcgtaccgttacggtacgtacgaccggtaccggacgttcccgg

SEQ ID NO: 149979 - DNA, 675 bp, Homo sapiens
  misc_feature: GYAE6OF02GBJYC.19.14.B03.1.454.CMB.1.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtgtccggtctccgtggacagtcagtcaccatctcctgcactggaaccngcagtgatggttggtgttataactatcgtctccgtagtaccaacaaccacccaggacaacggccccaaagtcatgatttangatgtcagtgacgccggcctcgtacggggtccctgtactcgtcttcgtcgtcggctaccgaagtcgacggacctaaccgaccggtccctacccgtaaccacttccgttcgtcggggcccttaccggacggtccgtaggacggtacgtgggaacggtcttaacgttagtttaacgtttacgtcggtcgttagaccttaatacgttaagtcgtacgtaaacggtcggttaacggttaacttacgggttttaggttaccggttaccggggacgggttaaccggtaacccgtaacggttcccggttaaccgggtaccccggttaccggttacgggtacccgaacccgggtaccccgtaagggtccccccgg

SEQ ID NO: 149980 - DNA, 781 bp, Homo sapiens
  misc_feature: GYAE6OF02ISX30.19.14.B03.1.454.CMB.1.raw
  modified_base (162)..(162): a, c, t, g, unknown or other
  misc_feature (162)..(162): n is a, c, g, or t
tcagtactctcgtgcacgaccggtgctcgatttagtgtgagtagttccggcggggggggggtctcaggaggcagcactctcgggacgtctccaccatggcctgggctctgctcctctcagcctcctcactcgagggcacgaggatccgtgggctacaggtcncgaccctgactcacgcctcactcagtcggtccggtctccgtaggacagtcagtccactactcgtcctgacctacgtacggaaccagtccgaggtatgttggttacgggtagttaactaacgttagttcgtcctcgttacggtaaccaaaccgtaaccgtacccggaggtaccgaacccggtaaccccaagtacgtacgttacgttagttttacgaacggtacgtcggtaacgtacggtacgtaccggaccccggtaccgtacggggtaccggtcctacggtacgtccgttcttccgtacggtccgtaccggttaccgtacgtaccggttacggaaccgtacccgtacccgggaccctttaacccgaaccttcgttaccggtaccgttaccgggtccgtaacgtcggacggttaggtacggtacgtaggttccggtacttaccggttacttaacgttcgacggttcgttctacgtacttaacgtacggtacgacgggttaccgtacgtacggttacgtttacggtacggtttacggtaccgggtaacggtacggacgtaacggtcccgtaccggttaaccggtcggtaaccgtaccgcggttaacccggccgttacccgg

SEQ ID NO: 149981 - DNA, 705 bp, Homo sapiens
  misc_feature: GYAE6OF02F8II8.19.14.B03.1.454.CMB.1.raw
tcagtactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtcgtccgggtctcctggacagtcagtcaccatctcctgcacgtggaaccagcagtgattggtggtgttaatactatgtctcgtagtaaccaacaaccaccgagaccgaacgacccccaaagtcatagtattatagtatagtcgtaggtcgtacggccggtcccgtacggtaccgggtccctagtacgtccgtcttccgtcgtcgtccgtacctagtcgtacgacaaccgtccgtaccctaaccctacctactccgttacgccgggtaccctcgtacgggtcgtaggaacggtaccgtaggtaccggcgtttaagaacgtttacgtaccttcgggacctttcggtacctagttacgtacgtaccggtagtaaccgttcgtaacggttaacctttaacgggttcgggttaacgggttcccgggaaacgggggtacccgggtaaaccgtaacggttaccgggttaacccggttaccccggtaacggttaaccgggttcccaaccggttacccgggaaccgttcccccggg

SEQ ID NO: 149982 - DNA, 593 bp, Homo sapiens
  misc_feature: GYAE6OF02IP2RE.19.14.B03.1.454.CMB.1.raw
  modified_base (210)..(210): a, c, t, g, unknown or other
  misc_feature (210)..(210): n is a, c, g, or t
  modified_base (215)..(216): a, c, t, g, unknown or other
  misc_feature (215)..(216): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgactcagcctcactcagtgtccgggtctccgtggacagtcagtcacntctcnncacgtcgaacngcagtgatggttggtgttataactntgtctcgtagtaccaacacaccagaccaacgaccccaagtcatgtattatgtatgtacagtgacgccggtccctaggtaccgggtccngtacgttcgtcttctacgtcgctacgacgtcgcgacaccgaccgccctacctacntcctcgtcgcctcgagcgtagagtagtggagtcttagtatttacgtacgngtcgtacgtctagtacttagcgacgtgggacttacggttaacttcggtttacggttaggtaccggggacgggtaaaccggaccggttagccggtaccgtacccgggttaccgtacggtacccgacccggtacccggacgtacccccgg

SEQ ID NO: 149983 - DNA, 587 bp, Homo sapiens
  misc_feature: GYAE6OF02I97HJ.19.14.B03.1.454.CMB.1.raw
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctgggctcagtctgccctgacctcagcctcactcgagtgtccggtctcctggacagtcagtccacattctcctgcactcggaaaccngcagtgattggttggtagttataactatgtctctgtaaccaacaaccaccaggcaacggaccccaaagtccaatgtattangtatgtacagtagacgccggtccctgacgggtccctgactcgtcttcgtctcggctaccaagtctacggaccaaacgtccggcccttacccaaacctctcctacgtccggctaccgagtaccgtaggacgagtggacgtctagttacttacttacngtctagccttanagtttancgcgaacggccgttaagattacgtttggttactcggggcgtaaacggacgtacgtaccggtacgacccgttcgaacggtccaacggtaccgaggtcccg

SEQ ID NO: 149984 - DNA, 719 bp, Homo sapiens
  misc_feature: GYAE6OF02GA9BO.19.14.B03.1.454.CMB.1.raw
  modified_base (231)..(231): a, c, t, g, unknown or other
  misc_feature (231)..(231): n is a, c, g, or t
tcagtactctcgtgcacgaccggtgctcgatttagtgtgagtagttccggcggggggggggtctcaggaggcagcactctcgggacgtctccaccatggcctgggctctgctcctcctcagcctcctcactcagggcacaggatcctgggctcagtctgccctgactcagcctcactcagtcggtccgggtctccgtgacagtcagtcaccatcctctgcacgtggaaccngcagtgtagttggttcggttagttaataactattcgtcctaccgtacggtaaccaacaaccaccgaggacctaaccggacccccaagtctagtacgtactttaagtggtattagtacgtaggtcgacggtcccggtacccgtcggaccggggttccctaggtacgtccgttacgtttccgtcgtcggtacctaccgaaggttccgtacggaccgtaacccggtacccgtaccccttacccctaaccgtacgttcgtccggtcgggtaccctccggtacgggtcgttacggacgggtactaggtacgtcgttagtacgtttaactcgtacgtctcgtaccgtctattacgcgtacgtacgaacggttacggtacgtttacgggtttacggtacgggttaccgggacggggtaaaccggtacgtaacggttccgtacggtacccggttacggtaaccggttccgaaccggtccccggtacgtacccccgg

SEQ ID NO: 149985 - DNA, 704 bp, Homo sapiens
  misc_feature: GYAE6OF02GHGGQ.19.14.B03.1.454.CMB.1.raw
  modified_base (266)..(266): a, c, t, g, unknown or other
  misc_feature (266)..(266): n is a, c, g, or t
  modified_base (554)..(554): a, c, t, g, unknown or other
  misc_feature (554)..(554): n is a, c, g, or t
tcagtactctcgtgcacgaccggtgctcgatttagtgtgagtagttccgcggggggggtctcaggaggcagcactctcggacgtctccaccatgcctgggctctgctcctcctcagcctcctcgactcagggccacaggtatcccgtggacctcagtctcgccctgactcgacgtcctcactcgtagtccggtccggcttccgaggacacggttacaacgtccaaaccgtcttccgttccgaggtaccgaaccgtacggaaacccnggtactaggttggaacgttttgggtttacggtaaggtttaactaacgttactacggttccttaccggttacggtaacccaaacaacccgtaaccgacggtaccgaaccggaaccccgtaagtaccgtaacttagttacgttacgtagtacgttaccgtagtacggtacgtaccggacccggtccgtacgggtaccggttccgacgtacgtacgttcgtccgttgcgtaccgtacgtaacgtcgaacgtacgacccgtacctccttacactacgcgtcgccgtctacgngtcgtagacgactcggtatcgttaatacttacgtactcgacgtcacgtctacgtagtcgacgacggtactacgtacgttcgttacggtgtaccgggacgacggactacggccgtacgacccgtacgttccgacgtaccgacgtcgtcccg

SEQ ID NO: 149986 - DNA, 942 bp, Homo sapiens
  misc_feature: GYAE6OF02H8DUC.19.14.B03.1.454.CMB.1.raw
  modified_base (299)..(299): a, c, t, g, unknown or other
  misc_feature (299)..(299): n is a, c, g, or t
  modified_base (618)..(618): a, c, t, g, unknown or other
  misc_feature (618)..(618): n is a, c, g, or t
  modified_base (747)..(747): a, c, t, g, unknown or other
  misc_feature (747)..(747): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacaggatcctgggctcagtctgccctgactcagcctcactcagtcggtccggtctccgtggactaggtcagtccacctattcctccgtacgacctaccgttaaggaaaccctagaccgtaggttacgagttcggttggggttagtttaaacgttaaaccgttntccggttccttaccggttacggtaaaccccaaacctaaacccgaacccggagggtaaccaaaacccggtacccccaaaaaggttccaacgttaggttaacttttaacgacggtaacttaggtcgtaaagtcggacggtacccggtaccccgtaccgggtaaccggggttcccgaggtacccggttcttccgttaccgttccggtaccggtaccttaaccggtaagtttaccggaccggttaaccgaaacccgtaccccgggttcccctaaaccccttaaacgtcccgttcccgtttacccggggtacggggtaaccccncccgggttaacggggtaacccttagggggggaaaccgttacggtaccggggtaaaacgggttttcccaagggtttaaacctttttaaccgtttacccgggaaacgtttcccggtacgggttaaaccccngttttaaaacgggtaagtccgtaccggaacgggtacccttaacgggtttaaccgttaccgttttaaggggtaccggtagggggttaaacccgggacccggtaaacggaacccgttcccgggttaaccggttaaaccccgggtacggttaaccgtacccgggtaaccgggttacccggaacccgggtttcccccgg

SEQ ID NO: 149987 - DNA, 731 bp, Homo sapiens
  misc_feature: GYAE6OF02JEFKB.19.14.B03.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (568)..(568): a, c, t, g, unknown or other
  misc_feature (568)..(568): n is a, c, g, or t
  modified_base (722)..(722): a, c, t, g, unknown or other
  misc_feature (722)..(722): n is a, c, g, or t
tcagtactctcgtgcacgaccggtgctcgatttagtgtgagtagttccggcggggggggggtctcaggaggcagcactctcgggacgtcctccgaccatggcctgggctctgctcctcgtcagcctcctcactcagggctacaggatccgtgggctcaggtctcgccctgacctcgacgtcctcactcgtagtcggtccggtctccgnggtacacgtcacgtcaaccngtccgtctcgctacggtacgaacccngcgtaacgtcgtagttggttaggtaacgttaactaactagtcgtacctccgtacggaacctaactacccgaccgtaggacctaacggtacccaaagtccgtagttagtacgtttaatacggtacgttacgacgtgtacggtagtcccggtaccttacggacgggttccctagtacctcgtcttacggtctcggtacctaaccgagttccggtacacgaacccgtaccgtacccttacccgaaccttcgtacgtcggtcgtacctcgtacgtcgaggtaacgtagttagcgtacgttacgaacgtttacgttacncggtacgttacgtacgttaacgtaccgtaaagttcggacgttaaccggggtacttttacgggaaccttttcggggttacgtttaccgggaccgggttaacggaccgtaacgtcgtacgtccgtaaccggtacggtcccgtaacgcgttacccgnggttacccg

SEQ ID NO: 149988 - DNA, 682 bp, Homo sapiens
  misc_feature: GYAE6OF02H14U8.19.14.B03.1.454.CMB.1.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
tcagtactctcgtgcacgaccggtgctcgatttagtgtgagtagttccggcgggggggggggtctcaggaggcagcactctcgggacgtctccaccatggcctgggctctgctcctcctcagcctcctcactcagggcacaggactccgtgggctcagtctcgccctgactcacgcctcactcagtcggtccgggtctccgtggacagtcagtaccacctatctcctgcagtcggaacagcagtgagttggttgtgttanaactntcgtccaccgtacaacaccaccaggccaacggtaccccaagtctgtagtattaagcgtatgactagtgcgtccgaccgtcggacgggttcctaggtactccgtctttaccgtcggcgtaccacgttaacgtccgtaacgacccacggtacccgtaccctaccgtaactcgtacgtcgtacggtcggtaccacggtgtaccgtaggaggtacgtagggacgtacgttagtacgtttacgtaagtccgacgttagtaccttactaacgttcgacggtaccgtaacgggtacgttaaggttacccttagggtttcgttaacgggtcggggaacgttacccggggaacgttcgaaccggttccgttaaccgggtaccggttaacgggtaacccaaccggttacccggaccgtttaccccgg

SEQ ID NO: 149989 - DNA, 627 bp, Homo sapiens
  misc_feature: GYAE6OF02HUCQO.19.14.B03.1.454.CMB.1.raw
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (456)..(456): a, c, t, g, unknown or other
  misc_feature (456)..(456): n is a, c, g, or t
tcagtactctcgtgcacgaccggtgctcgatttagtgtgagtagttccggcggggggggggtcgtcgaggaggcagcactctcgggacgtctccaccatggcctggctctgctcctcctcagcctcctcactcgagggcacaggactccgtgggcctcagttcctcgccctagactcagccctcacgtcagtcgtccgggtctccgtggacagtcagtccacctactctcctgccacgtaggaaaccaggactgtagagtggtcggttagttataacgtatgtctcgtagtaccaacacaccaggcaacgacccaagactatagtattangtntcgtcagtagcgccgtccgcggacggtcccagcttacncttcncgtgtcctacgtacgtgtacggacaccaccgggtccccttaacctaacgacttcctcgtacggccttacgccgtgtacgnggtaatggacggtcgtgttaacttaattcgcgacttgaccgtactagactacggcgaacgtcgtaagtaccgttaggtttaggttacggtccggggaacgggtaccgaagtaaaccggtcggtaccacccggtttacgccgttaacggacccgttaccggaccggtacccg

SEQ ID NO: 149990 - DNA, 668 bp, Homo sapiens
  misc_feature: GYAE6OF02FPL6E.19.14.B03.1.454.CMB.1.raw
  modified_base (178)..(178): a, c, t, g, unknown or other
  misc_feature (178)..(178): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagcctcctcactcagggcacaggatcctggtctcagtctgccctgactcagccttcacncagtgtccgggtctcctggacagtcagtcaccatcctcngcactggaaccngcagtnatgtaggtgttaanaactntgtctcctacgtaccaacaaccaacccaggaccgaacgacccccaaagtcatgtatttatgagtgtangtgagccggtccctacgcgggtccctgtactccgtcgttctacgtcgtactaccgagtcgacggtacaaccgcccgtaccctaccctaaccgacgttcgtcgtacgggtcctaccggacggtacgttacggaggtaacgtacggtacggtacttacggttaattaacgttaccttacggtccgtaggtacccgtataacgttacgtacgaccgtaagggtccgttaacggttaacgtttacggtttacggtacgttaccgggggacggtaaccggaccgtaaccggtaccgtaccggttacccgtccggttaacggtacccgaccggtacccggtaccgtccccgg

SEQ ID NO: 149991 - DNA, 749 bp, Homo sapiens
  misc_feature: GYAE6OF02JIVGO.19.14.B03.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (556)..(556): a, c, t, g, unknown or other
  misc_feature (556)..(556): n is a, c, g, or t
tcagtactctcgtgcacgaccggtgctcgatttagtgtgagtagttccgcggggggggggtctcaggaggcagcactctcgggacgtctccaccatggcctgggctctgctcctcctcagcctcctcactcagggcacgaggatccgtggctcagtctcgccctgactcacgcctcactcagtcgtccggtctccgtggacngtcacgtccacctatcctcctgcctacgtcggaaaccncgctaggtgtagttgggttacggttacgtttaacttaactcgttcgttccgttaccggttacggtaaaccccaaaccgtaaccccgacccggtaacggacccgaaacccggtaccccctaaaaggtcctaacgtttacgttagtttacgcgtaacgttcgtaccgaggtacgaccggtaccggttccccgtaacggtccggggtccctaggtaccgtccgttcttccgtcgttccggaccttaccgtaacggtccgtacggaacctaacccgcccgtaccctaacctaccctctccgtacggtccgtaccgaccgngtacgtacggacgtcgtacggtacgttacgtacgttacgttacgtacgttcgtaacgtccgtactaacgtacgttatccggtagtccggtaacgtacgttacgtttaggtcggttaccggtacggcgggtaccgaacggtccgtaccgtccgaccggttaccgtaccggtacgacgtaccggtaccgtcccgg

SEQ ID NO: 149992 - DNA, 685 bp, Homo sapiens
  misc_feature: GYAE6OF02GER3X.19.14.B03.1.454.CMB.1.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
tcagtactctcgtgcacgaccggtgctcgatttagtgtgagtagttccgcgggggggggggtctcaggaggcagcactctcgggacgtctccaccatggcctgggctctgctcctcctcagccctcctcactcagggcacaggatcctgggctcagtctgccctgactcagcctcacctnagtgtcccgggtctcctggacagtcagtccactatcctccngcactacggaaccagcagngattggttggtgtatacntctcctcgtacgtaccaacaccaccaggacaacgacccaagtcatgtattangtatcgtnagngacggcccgtaccgtcggaccgggtcctgtacgtccgtcttccgtcgttcggtacctacgtacgttcgtacgaccgtaacgccccggtaaccttacccactaccgttcgtccgacggtccgtaccggtgtaccgaggtaggcgtaggacgttgtaatttacgttacgttactcgttcttacgctagttactaaggtccgtaacgcggttaccgttaaaacgggttctttaacgggtttacggtaccggggttacggggaacggggtaaccgggtaaccgttaccgggtacccgttacccggttaacccggttacggttaaacccgggtccgtaaccccgggtaccccgtacccgggtcccccgg

SEQ ID NO: 149993 - DNA, 797 bp, Homo sapiens
  misc_feature: GYAE6OF02GH9VA.19.14.B03.1.454.CMB.1.raw
  modified_base (517)..(517): a, c, t, g, unknown or other
  misc_feature (517)..(517): n is a, c, g, or t
tcagtactctcgtgcacgaccggtgctcgatttagtgtgagtagttccgcgggggggggggtctcaggaggtagcactctcgggacgtctccaccatggcctgggctctgctcctcctcagcctcctcactcagggcacgaggatccgtgggctcagtctgccctgactcagtcctcactcagttcgtccgggtctccgtaggactacgtcacgtaccacctactccgtcctacggacctaacgtacggaacccagctaaggtgtagttgggttagggtacgtttaacttaacgttagtcggttaccttaccgtacggttaaccctaaaccaacccgtacccggaacggtaccgaaacccggtaaccccaaagtctaagtagtatttaagagtatggtacgtacgtacggtcgcccggtccgtacggtacggtcctgtaccgttacgtccgtttcgtccgtacggtacctaccgtagtccgacgtaacacccggtacccgtacctaacccgttaacncgtcgtccggtccggcttaccgggaggtaccgggtaggacggtacgttaggggtaccgttactaacggttttaagttacctttacgacgtttccgtacctcggttaacgtacgtagttccggaacggtaacggtaccttaacgggttaacgtttacgggtttacggacgggtacccggggtaggggtaacccgaacgtaccggttaacgggtcccgttaaccgggttccggaaccgggtaccgaacccggtacccggttacgggtccccttaccccgggg

SEQ ID NO: 149994 - DNA, 488 bp, Homo sapiens
  misc_feature: GYAE6OF01AYTXR.33.25.C03.1.454.CMB.1.raw
  modified_base (380)..(380): a, c, t, g, unknown or other
  misc_feature (380)..(380): n is a, c, g, or t
  modified_base (482)..(482): a, c, t, g, unknown or other
  misc_feature (482)..(482): n is a, c, g, or t
tcagtacacacactcacgaccggtgctcgatttagtagtgtagatttgggtttggggcggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctctggagtccccagccgcttctctgatccaaggatgtttcggcaacgcagggattttacncatctctgggctccagtctgacgatgagctgactattactgtatgatttggcacatcaaacgcttgggtgttggcggagggacaagctgaccgtctaggtcngacccg

SEQ ID NO: 149995 - DNA, 780 bp, Homo sapiens
  misc_feature: GYAE6OF01D7YG8.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttgatacctacaggatattctggtaccagcagaagccagatagtccctccccggtatctcctggaggtacaggtcagactcagatacgcagcagggctcgtcggacgtccccagcccgctttccgtcgtgggactcccgaaaggtactttcgggttttaccgggacccgtaacggaccgtaacggggttaacttttttaccgtaccgtaacgtttccgttaccggttcgggggtaccccttacccgtaacggtttcccgttacgggtaaacccggtaagtttcggggaacgggttcccgttaacgggtaaaccttttaacgttttaacccgttaggtttaacgtttaggtttaacgtttttacggggacccttaaacgtaacgtttacccggtaaaaccgggtttccgggtttttacggggggttcgggttttacccgggggaaccgggggttaaaccgggggtaaaccccgtaaaggggtcccgtttaccggggtaaacccccgggttttaccccggttaaacggggttcccgaaccggggtaaaccccccgg

SEQ ID NO: 149996 - DNA, 798 bp, Homo sapiens
  misc_feature: GYAE6OF01CIN6K.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctccttgagcatcagccagtctcacctgcaccttgcgcagtggcatcaatgttgatacctacaggatattctggtaccagcagaagccagatagtcctccccggtatctcctgaggtacaggtcagactcagatacgcagcagggctcgtggacgtccccagcccgcttcctctgggactacccgaaaggtacttcggttttaccgggacccaaaccggtccggtaagggggttaacttttttaaccgtacctaatttccgttccgttcgggggtcccttacccgtaaggtttccgttacggtaaccggtaagtttacggggaacgggttaccgttacgggtaaaccgttttaacgttttaaccgtttacgggtttaacgtttacgggtttaaagtttttttccggggacccttaaaccgtaacgtttaaccccggtaaaaccggggtttcccgggtttttagggggggtttttaccggggttttacccggggggtacccggggggtaaaaccggggggtaaaccccgttaaaacgggggtccccgtttaacgggggtaaaccccccggttttacccggttaaaccgggggtttccccaaaccgggggtaaacccccccggg

SEQ ID NO: 149997 - DNA, 524 bp, Homo sapiens
  misc_feature: GYAE6OF01EGLXK.33.25.C03.1.454.CMB.1.raw
  modified_base (327)..(327): a, c, t, g, unknown or other
  misc_feature (327)..(327): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaaatgttgatacctacaggatattctggtaccagcagaagccagatagtcctccccggtatctcctgaggtacaggtcagactcagatacgcagcagggctcgnggatccccagccgcttctcgtggactccgaaggtatgtttcggccaacgcagggtatttactcatctgtggctccagtctgacgatgaggctgactattactagtatgtatttggctacatacaacgtcttggggtgttcgggcgggtacgggaccgaaagcgtacgaccgttaccgtaggtcgaaggtaaccccgg

SEQ ID NO: 149998 - DNA, 677 bp, Homo sapiens
  misc_feature: GYAE6OF01DVLUG.33.25.C03.1.454.CMB.1.raw
  modified_base (469)..(469): a, c, t, g, unknown or other
  misc_feature (469)..(469): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctccgtggagcatcagccagtctcacctgccacttgcgcaggtgctatcaagtgttgactacctacgaggtattattcgtacggtaccagacgaagaacgccagtactaccgtccccttacccggtatcctaccgtgacggtacgacggtcaagactacgagtactacgcaggcgaggtctacgtacggaccgtaccccgagcccgtcttccgtcgtacgggtactaacccggtaaaggtcgtttacggttacccggaacctaacggtacggtaacgggtttaacttttaacncgttacgttccgttacggtccgggtacctacccgtaggtaccgttacggaaccgtaggtacgtaggtacccttaggttaacctttaacgttacgtttagttaagttacgtttacggttcgactaagtacgtagttaccgtggttacggggtcgtacggggacggaacggtacgaagtccgtacggaccgtggtacgcaacggtacccg

SEQ ID NO: 149999 - DNA, 758 bp, Homo sapiens
  misc_feature: GYAE6OF01DSAJ7.33.25.C03.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatacaatgttnactacctanagtatattcgtgtacagcaagacgccaagtactacgtcccctccccggtatcgtcctggacggtacgaggtcagactacagactacgcagcgagggtctcgtacggaccgtccccgacgtcccgtcttcgtcgttacgacgtaccgaaaggtcgtttacgggtttaccggacccgtaaacgggtccgtaaaggggttttacctttttaacgaccgttaactttccgttcgggttccgggttacccttcccggtaaacggtttccgtaacgggtaaccttaggtacggtacgggttaccttaacggttaaccgttttaaagttaccgtttagggtttaacgtaggtttaacgttttaccggacctaaaccttaacggttaccgtaaaccgggtttcgggttttacggggggtttaccggttaccgggggacgggggtaaaccggtacccgtaaacgggtcccggttaaccggttaaccccggttacccggttacgggtaacccgaccgggtaaaccccgg

SEQ ID NO: 150000 - DNA, 720 bp, Homo sapiens
  misc_feature: GYAE6OF01BJNQN.33.25.C03.1.454.CMB.1.raw
  modified_base (255)..(255): a, c, t, g, unknown or other
  misc_feature (255)..(255): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgactacagagtattatgtacgtacgnacgagacacgatagtccgtccccgtaccgtactcctccgtaggtacggtacgtacggtacgacgtacctacgaacgtacgaccgtacgacgtacggggacggttcctgggtaaccggtaccccgtaccccgaccggtcccgtttcccttcccgttaggtacgtaccgtaacccgggtaaggttacggtttacccgggtttacccggaaccggtaacccggttacggggtaacgggttttttaacctttacccgagttaccgttccgtacggggttccgtaccctcgtacgttcgacggtatcggtaggtccgtgtacctaatttacgttaggtacgttagttagttcgttacgacctacgttaccaaccggttacgtttcggggttggttccgggtaggggaccgggtaacgaaccgtggtacccgtacggttacccggttacgacggcgtacccggaacccggg

SEQ ID NO: 150001 - DNA, 695 bp, Homo sapiens
  misc_feature: GYAE6OF01EXOM2.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgccaccttgcgcagtggcatcaatgttgatacctacaggatattctggtaccagcagaagccagatacgtcctccccggtatctcctgaggtacaggtcagactcagatacgcagcagggctcgtgggacgtccccgagtcccgtctttcctcgtaggtactacccgtaaaggtacttcggttttacccgggacccgtaaaccgggccgttaaagggggttaccttttttaacctccgttaacgtttccgttaccggttacgggggtcccttacccggtaacggttccgttacggtaaccggtagtaggtacgggtccttacggtaaccgtttaatttaaccgttaggttaacgttagttaacgtttacggcctaaactagttacccgtaaacggttcggtttaggggttcggtttcggggacgggtacggggaaccctaaggcccgttaacgggtaccccggttaccgtagggttcccgacggtaccccgg

SEQ ID NO: 150002 - DNA, 626 bp, Homo sapiens
  misc_feature: GYAE6OF01C0LYQ.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgccaccttgcgcagtggcatcaatgttgatacctacaggatattctggtaccagacagaagccagatacgtccctccccggtatcctcctggacggtacaggtcagactcagatacgcaggcgacgggctcgtcggacgtcccccagcccgtctttctcgtggactaccgaaggtattcggtttccggacccaacggccgttaagggttactttttaaccgctacgttcctcggttgggtcccttaccgagttccgtagacgtagtcggaacggtcctagtaaccttattacgtgttagtgttagtttcggacactacttaccggtaacgtcggtttaggggttcggttaccggggacgggtacgggaacccgtaaggtccgtacgggtacccgttacgttacgggtccacggtaacccccgg

SEQ ID NO: 150003 - DNA, 639 bp, Homo sapiens
  misc_feature: GYAE6OF01BD7CT.33.25.C03.1.454.CMB.1.raw
  modified_base (296)..(296): a, c, t, g, unknown or other
  misc_feature (296)..(296): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcacagtggcatcaatgttgatacctacaggatattctggtaccagcagaagccagatagtcctccccggtatctcctgaggtacnggtcagactcagatacgcagcgagggctcgtggacgtccccgagcccgtcttctcgtgggactaccgaaaggtacttcggttttccggacccaacggcgtaagggttacttttacgtctaactccttacgtcgggtccctccgtagttccgtagtacgagtcggaggtctgtaacctttaattacgttagttaattggttaagttttcgggactaacgacttaccgaaacggttccggtttaggggttcggtttaccgggggaccgggtaacggggaaccctaagggtcccgtaacggtaccccggttaccggttaccgggtcccgtaccggtaacccccggg

SEQ ID NO: 150004 - DNA, 723 bp, Homo sapiens
  misc_feature: GYAE6OF01EZ687.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatcctccgtggagcatcacgcctagttcctccacctcgacctaccttgcgcgaggtcggacatacctaattgttagacttacctacgaggtattacttcgtacggtaccagcaagaacgcagtactacgtcccgtcccgtatcctccgtagtacggtacaggtacacgacctcgaagtactacgcgacggccgagggtcctcggtacggaccgtccccgacgtcccgtcgtttcgtcgtacggtaaccgtccgtaaggtcgttacgggtttacccgaccgtaacggtcggttaacgggttactttacgtacgtacttccgtacggtcggtaccctacgtacgtacgtcggtaacgtggtacggacgtcgttacggtaacttacgttaacgttagtaacgttgttacgttacgacccgtaacttacgttacccgtaacggttccgggtttacgggggttcggttaccgggggacggttaaacggggacccgtacgggtacccgtaccgggtacccgttaaccggtccgggtaccgtccggtaaccccggg

SEQ ID NO: 150005 - DNA, 714 bp, Homo sapiens
  misc_feature: GYAE6OF01BNAVA.33.25.C03.1.454.CMB.1.raw
  modified_base (186)..(186): a, c, t, g, unknown or other
  misc_feature (186)..(186): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatcctcctggancatcacgccagtctcacctgcaccttgcgcagtgcatcaattgtagaactacctacgaggtattattcgtggtaaccagtacaagaacgccaagtacttaccggtcccctcccggtatccgtccgtaggaacggtaccaggtccaagtacctacgaagtacgtaccgcacggtacgacgggtctacggtacggtaccctccccgagtcccgttacttccgtcgtacggtaactacccggtaaaggtctttccgggttacccggaaccgtaaccggtcgttaacgggtttaacttttaccataccgttccgttacggtccggtacccttccggtacggttaccgacggtacgtacgttgggacggtccttaaggttacccttaagtttacggtagtttacgttaggttaacgtttcgaaccttaacgtaaccgttacggtacccggtttgggttacggggtccggttacggggacgggtaaccggaactacggtcgtaccgtaccgttaccgagtcccgcgtaacccgg

SEQ ID NO: 150006 - DNA, 637 bp, Homo sapiens
  misc_feature: GYAE6OF01EECH6.33.25.C03.1.454.CMB.1.raw
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtcctcacctgccaccttgcgcagtggcatacaatgtgactacctacgaggtattattcgtacggtaccagcaagaacgaccaagtactacgtccccgtaccccggttatcctccgtaggaggtacgacggtacacgtactcgaagactacgcgagcgacggctacgtcggaccgtcccacgcgtcttctcgtagtactacgaaggtnttcggttacgaccgacgcgtaggttactttacnctatctcgtcggtcctacgtgtctaggacgtagtggagtactacgtaactttaacttacgttagttagttagttagttcggacctaacgtacgtacgaacggttgggtttacggggtcggttaccggggacgggaaccggtaaaccgtacgtccggttaccggtacccgttaacggtaacggtccggaacccgtaacccggg

SEQ ID NO: 150007 - DNA, 664 bp, Homo sapiens
  misc_feature: GYAE6OF01E2E1L.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatacgtccctccccggtatcctcctgaggtacaggtcagactcagatacgcagcgaacgggcctcgtcgggacgttcccccgacggcccgtacctttccgtcgtagggtaacctacccgaaaggtacgtttcgggttttacccggacccgtaaacggccggtaaggggttactttttaaccgtactacttccgttccgttggggtcccttacccgtacgttccgtacggaacgtagtcggtacgggtcttagtaaccttatttaccgttagttaattgtacgttttcggacctaacacttaccgtaaacggtcgtttacggggtcggttccggggacggggtacggtaacccgagtcgtacggtacccgttaccgtacggtaccgccggtaaccccgg

SEQ ID NO: 150008 - DNA, 666 bp, Homo sapiens
  misc_feature: GYAE6OF01D6CTS.33.25.C03.1.454.CMB.1.raw
  modified_base (276)..(276): a, c, t, g, unknown or other
  misc_feature (276)..(276): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctccgtggagcatcagccagtctcacctgcctaccttgcgcagtgcatcaatgtagactacctacgaggtattacttcgtacggtaccagacgaagaacnccaagtactacgtccccgtccccggtattcctccgtggtaacggtacgtaggtcagactcaagtactacgcaggcgacgggctcgaggtaccgtccccgagcccgtctttccgtcgtacggactaccgaaggtctttccgggtttaccggacctaacggtccggttaagggttacctttttacgactacttccgtacgttcgggtcctaccgtagtcgtacgacgtgtggacgtctacggtactttaagttcgttagttagttcgttagtttacgacctaactaacgttccgtaacggttggttttacggggtcgttacgggggacgggtacggaaccgtaggttcccgtacgggtacccgttacggaccggtcgacccggtaacccggg

SEQ ID NO: 150009 - DNA, 723 bp, Homo sapiens
  misc_feature: GYAE6OF01CQPC0.33.25.C03.1.454.CMB.1.raw
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
tcagtacacacactcacgaccggtgctcgatttagtagtgtagatttgggtttgggggcgggggtaagaggttgtgtccaccatggcctggactcctctcctcctcctcgttcctcttctcacgtgctacaggttcccctctcgcacggctgtcgcttgacttcacgtcccggctttcccctctcgtcgacctacttccctcccgtaggacgcctaattccggacgacccgtacgttccgttccccacgtcgaccttccttcgcgtcgagtcggcctagtacaagtttcgttcaactaacctacgtaggtattcttcgtacggtaccgagacgaagaacgccgaaggtagttaccgtccccgtcggttacttccgtaccgaggtagtaccgngtacgacgtacaagtagtccgacgcacgtaacgnggtccgtacgtacggcccaccgagtccttcttccacgtagtactcgaagtcgttaccgccgacgaacacgtagtactttcgactactcgtacgtccgtacgtaccgtcgtacgtacggaacgacgtacggtacgtacgtacggttaacttacggttacgttacgttaagttcggtaagtttcggaacgttactagtaccgtaccggttaccggttcggttccggtaacggtccggtaacggaccgtacggtcggtaccggttacccggtagaccccggttacggaccggtaacccgg

SEQ ID NO: 150010 - DNA, 763 bp, Homo sapiens
  misc_feature: GYAE6OF01DM8BN.33.25.C03.1.454.CMB.1.raw
  modified_base (171)..(171): a, c, t, g, unknown or other
  misc_feature (171)..(171): n is a, c, g, or t
  modified_base (566)..(566): a, c, t, g, unknown or other
  misc_feature (566)..(566): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgccacaggttccctctcgcaggctgtgctgactcagccggtcttccctntctgcatcctcgtggacgcatcacgcctagttcctcaccgtcgcctacccgtttgccggacgtaggttacggacctaacttacctaagtttcggtttacgaacttaccccgtaaggtaaggtaattttacgttttccgtagggttaacccaggacgtaaaggaaccgaccgaaaggtacttaaccggttccccgttacccccgggttaatcccgtttaccgttagggaccgggttaaccgtacggtacgacgtacgtcaaagactaacgcacggtcgtacggtccttacggtacggacccgtccccgagttcccgtctttaccgggtccgtagaccgttacggaaggtttacgttcggtaccgggtaccaacggtcgtaacgggtttctttaacncgtacttccgtgtaccgtcctcgtagtcagtacgtgtcggacgtactaggttaactttacttacgttagttacgtacgttacgttcggactaacgtactacggtacgttggttaacgggggtcgttacggggacggttaccgggaactaccggtcgttacccgggtacgtaccgttaagggccgtaccggacccggg

SEQ ID NO: 150011 - DNA, 864 bp, Homo sapiens
  misc_feature: GYAE6OF01B8MAS.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacacggtttccctctcgcaggtctgtgctgactcgacgccggtcttccctctcgtgactacttccgtccgtggacgctactcacgcctagtcctcctacgtcgacctaccgttgccgagtggtcggactagtactaagttcgttagtactacccgtaagacggtattacgttcggtacggtaaccgagaaccgaaggaacgaccgtagtaccgtttaccgtacccccgttaccggttacgtcctaccgtaggtacgtacgtacggacaacgtacctacgaagtaccgtacgacgaagggtccgtacgggtacctaccggtaccggtacccgtacccgacgtcccgttacgttcgtacggacgtactaccggtaaggttaccgttacggttacccgaacggtaaccgacggtttacggttttaacctttccgactttaacggtttccccgtacggggtacccgtacgtaccgtagggtttaccaacgggaacgttacccggtaggttaccggtaaaccgtttaaccgtttaacgttttaacggtttaacgtttacgggttaacgggttttaacgtacgggttttaacccgaccttaaacgtaacggtttacgggtaccggttaccggggttttaccgggggtaaccggtaccggaccggggtttaaaccggaacgttacccggttacggttaacccccggtaggtaccggtttaaacggcccggtaccggtaacccccggg

SEQ ID NO: 150012 - DNA, 808 bp, Homo sapiens
  misc_feature: GYAE6OF01A6JKT.33.25.C03.1.454.CMB.1.raw
  modified_base (219)..(219): a, c, t, g, unknown or other
  misc_feature (219)..(219): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggccttccctcgtctgctattccgtccgtaggacgctagtcacgccacgtctccaccgtncctacgttcggaccgacgtaggtcggctaatactaattggttacaaccgttaacctaagagggttaactttacgtttacgtacggtaaccaacggacaaacggaacgaccgtaaggttacctaccggttcccccgttaccccgttatcccgttcggacggtacggttaccgacggtaccgaacgactacgaagtaccgtaacgcgtaacggacggcggttcctacggttaccggaaccccgtaccccgtcggtcccgtttaccgtttcgaccgggtaactaccgtaaagttaacgggtcgtttaacggggttcccgaaccgaccggtaacggttaacggtttactttaactacggttacgttacggttccggtcgttacctaccgtaccgttcgtaacggtacgaggttacgggtgtaaccgttagttacctttaagttacgttacggttaggtacgttttaacggtcgactaacgtcgttaacgtacggttacgggttttgggccgggttacgggacgggtaacggaccgtaaggttccccggtaacggtacccgggttaacgtccggaaacccgcccggtaaacggg

SEQ ID NO: 150013 - DNA, 890 bp, Homo sapiens
  misc_feature: GYAE6OF01BF2DD.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcgacggcccggtcctttcccctctctgccacttccgtccgtgggacgcctaatccacgcctacgttccctaccaccgtcgccctaccttcggccgacgagggtcggactaacttaccgtaagtttcggtttacgtaaccttaaccgtaacggaaggttactttacgtttccggttaccggtaaccgacgaacgaacggaaccgaccgtaacggtacgttacccggtttcccccgtaccccgttacgttacccgttccggtagggtaaccggttacgaccggtacgaacgtacgtacggaaagttccggaaccgcggaacgtcgggtaacggttcctcggtaccggtaccccgtacccgtaccggtcccgttaccgtttccgttacggtacgggtaacccgtaaccggtaacggtttccgtttaaccggtttacccggaacccgtaaccgggttacgggtttaaacggttttaccttttacctaccgtttaacgtttccggtaccggttccggtaccttaccgttacggttaccgtacgtacggtagtacggtcgttacgttacgttaactttaagttacgttggttacgttgttacgttacggaccttagtaacgttacgtacggtttacggttcgggttacggtaacccggggacggttaaccggacccgttaggttacccggtaccggtttacccggtaaccggttaccgtaaccggaccccggttaacccggg

SEQ ID NO: 150014 - DNA, 735 bp, Homo sapiens
  misc_feature: GYAE6OF01D03FB.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctccgtggagcatcacgcctagtcctcacctgcctaccttgcgcagtggcatacaattgttagactaccgtacgaggtattacttcgtcggtaaccagacaagaacgaccagacttacgtccccgtccccggttactccgtccgtaggtaacggttacgacggtacacggtactacgtagtaactacgcgaggaccggacgggtccgttacggtacgggtacccgtcccccgaggtcccgttacctttcgtacgtacggtaacgtaccggaagggtagtttccggtttacccggaccgtaaccggtacgtaacgggtttaactttaccgttactacgtttccgtacggttccggtaccgttaccgtacggttaccgtacggtacccgttaggtacggtacggtacgttacgttaacgtttaacgtttcggttagttaacgtttaggttacgtttacgacttaacgtacttaccgtacggttcggtttacgggtcgggttacgggacggtaacggaccggttaagccgttacggtaccgtaccgtaggcctccggtaccg

SEQ ID NO: 150015 - DNA, 747 bp, Homo sapiens
  misc_feature: GYAE6OF01C9FVS.33.25.C03.1.454.CMB.1.raw
  modified_base (186)..(186): a, c, t, g, unknown or other
  misc_feature (186)..(186): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatcctcctggancatcacgccagtcctcacctgctacctgcgcagtgcatcaatgttagactaccagagtattattcgtggtaccagacagaacgaccagactacgtccccgtccccggtatccgtacgtacggacggtacgtacggtaccacgacctacgaagtaacgtaacgcgaacgccgagggtcctacggtaccggtaccgtacccccgagtcttacggtcctttcgtacggtacgtaacctaccggtaaggttacgttacgggtttaccggaaccgtaacggtacggttaacgggttactttacgtactacgttcgtcgtcggtcctaccgtacgttcgtacgtaacgtagtacggtacgtacgtaacgttaaccgttaacgtttacgttaggttaagttacggtttaacgtttcggaaccttaaccgttaacggtaaccgtttaacggtccggggttttaggggttaccggggttacgggtaaccggggaaaccgggtaaaccggtaacggtccggttaaccgggttacccggtttaaccggtacgggtaacccggtaaacccggg

SEQ ID NO: 150016 - DNA, 530 bp, Homo sapiens
  misc_feature: GYAE6OF02GIPAB.33.25.C03.1.454.CMB.1.raw
  modified_base (359)..(359): a, c, t, g, unknown or other
  misc_feature (359)..(359): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctcgtggacgtccccagccgcttctctggatccaaggntgtttcggccaacgcgagggtattttactcatctcgtgggcctccagtctgacgatgagctgactattactgtatgtatttgctacatcaacgtcgttaggggtgttccgggacgggtacgggaacctaaggcgttacgggtacccgttccgtacgggtcacggtaccccg

SEQ ID NO: 150017 - DNA, 682 bp, Homo sapiens
  misc_feature: GYAE6OF02FTYX1.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttccctctctcactgcgacaggttccctctcgcaggctgtgctgactcagccggcttccctctctgcatctcctggagcatcagccagtctcacctgcaccttgcgcagtggcatcaatgttgatacctacaggatattctggtaccagtcagaagccagatagtcctcccggtatctcctgagtacaggtcagactcagatacgcgagcaggctctggacgtcccccaggcccgtcgtttcgtcgtgggtaacttcccgaaagggtactttcggttttacccgggacccgtaaccggcgtaacgggggtacctttttaaccgtccgtacttccgttccgttacggggtcctcccgtacgttaccgttacggtaaccggtacgttacggtaacggtaccgttaggtaaccgttaatttacgtttagttacttacggttacgtttcgggtcctaacgtaacgttaccgtaacgttccggttagggttacgggtttaccgggaccggggtaacgggaccgtaacggtcgttacggtacccggttacccgttacggttaccgtacggtaaccccgg

SEQ ID NO: 150018 - DNA, 739 bp, Homo sapiens
  misc_feature: GYAE6OF02I9J0Z.33.25.C03.1.454.CMB.1.raw
tcagtacacacactcacgaccggtgctcgatttagtagtgtagatttgggtttgggggcggggttaaggaggtttgtcgtccgaccatggcctggactcctcttcccgtctcctggttcctctctcactgcacacggttcctctcgcaggctgtgctgactcaggccggcttccctctcctgccattccgtcccgtgggagtcacgtcagtccgtagttttcctcctaccgttgacctaccgttggcgcctaggtcggaccacctactaacttgttagtactttacctacgaggtacttatttcgaggtacctaggcaacgacgccgagtactacgtcccgtcccggtatccgttcctggacgtactggttccacggtacctcaagactaccgacacgcgacgggtcctcgtacgggaccgttccccgaggtcccgttcttccgtccttaggtactacccgaaggtacttcggttttaccgaccttaacgtcgtaacggtttacttttaccgtacgttacgttaccgtacggtcgggtaccgtccgtagttaccgtacggacgtacggtcggtacggtcgttacgtaactttagttaccgttgttacgttcgttacgttttccgccgtaactacgttaccgtacgttcggtttagggtttacggttccgggtacgggtaacggtaccgtaacggtccgttacggtacccggttacgtacgggtacctacggtaacccgg

SEQ ID NO: 150019 - DNA, 558 bp, Homo sapiens
  misc_feature: GYAE6OF02GVD40.33.25.C03.1.454.CMB.1.raw
  modified_base (238)..(238): a, c, t, g, unknown or other
  misc_feature (238)..(238): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagtcggcttccctctctgcatctcctggagcatcagccagtctcacctgcaccttgcgcagtggcatcaatgttgatacctanaggatattctggtaccagcagaagccagatagtcctcccggtatctcctgaggtacaggtcagactcagatacgcagcagggctcgtggacgtccccagccgtcttctctggactccgaaggtntggtttccggccaacggcgaagggtacttttactctatctcgtcgggcctccngttctgacgtatgagtctgacttattacgtgttacgtgtagttttggactactatactacggtcgtttgggtggttccgggacgggtaagggacccgtaagtccgttcggacccgttccgtaacggttccgaacggtacccgg

SEQ ID NO: 150020 - DNA, 913 bp, Homo sapiens
  misc_feature: GYAE6OF02G8J55.33.25.C03.1.454.CMB.1.raw
tcagtacacacactcacgaccggtgctcgatttagtagtgtagatttgggtttgggggcgggggtaagaggttcgtgtccaccataggccgtgggacttccctcttcccgtcctcctgttcctctctcactgcacaggttccctactcgcgaggtcgtgtgctgtacgttccagtccggcctttcccttactcgtgtccattcttcctagggagcaatcgaggcctaggttcgggtcctaccgtcgacctacccgtttggccggtcctagggtcgggacctacttcctaaagttggttacgaacgttaccccttaacgtaaggggtaatttactttaccgttacggtaaccgtaacggtacggaacggaacgacccgtaaggtaccggttacccggttacccccgttaccccgggttacttacccgtaccggtacggtaacgggttaccggtacgggtaccgtaacggtaccgtacggaacggtacgttaccggtacgacggtacggtaacgggtaccgttacggttacgggtaacccgtaaccccgtacggtacccgttaccttccgtaccgttacgggtaacgtaccggtaacggttacgtttaccggtttacccgaccgtaaccgtaccggtaacgggtttaactttaaccgtacttacgtaccgtacggtacggtaccttaccgtagttcgtacgtaacgtaggtacggacggtaccgtacgtaacgtttagtttacggttagttacgttaggttacgtttacggtacctaacgttaacgtaaccggtacggggttacggggtttacgggttaccgggttaccggggtacgggtaaccgggtaccggtaaccgttaccggttaaccggtacccggttaccggttaccggtaccgtacccgggtacccgg

SEQ ID NO: 150021 - DNA, 520 bp, Homo sapiens
  misc_feature: GYAE6OF02HFBQP.33.25.C03.1.454.CMB.1.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagtacacacactcacgaccggtgctcgatttagtagtgtagatttgggttttggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgagtacaggtcagactcagatacgcagcagggctcgtggacgtccccagccgcttctctggactccgaaggntcgtttcggaccaacgtcagggtattttaccnctagttctcgtgggcctccgagttctgtacgnttgngctgactattacngttatgtattgacactatcacgtcttgggtgttcggcggaaggtaccaagtcgtacgaccgtctacggtctaggacccg

SEQ ID NO: 150022 - DNA, 678 bp, Homo sapiens
  misc_feature: GYAE6OF02HWRLA.33.25.C03.1.454.CMB.1.raw
  modified_base (193)..(193): a, c, t, g, unknown or other
  misc_feature (193)..(193): n is a, c, g, or t
tcagtacacacactcacgaccggtgctcgatttagtagtgtagatttgggtttgggggcgggggtaagaggttgtgtccgtaccatggcctggtactcctctcctcctcctgttcctctctcactgcacaggttccctcgtcgcaggctgtgcgtgacctcagccggtcttccctctctgcatctcctggacnctatcacgcctagtcctcaccgtcgcctaccgttgcgacgaggtcggctaagtcgtaagttggttagaacttaccttacgaggtattattcgtggtaaccagctaagaacgcctagtatacgtcccgtccccggttatccgtaccgtggaacggttaccacggtcacgactacgagaactacgctagacgacgggcttcgtggtaccgtcccacgtccgtcttccgtcgtagtacgtaccgaaggtacgttcggtttaccgaccgtaacggcgtaagggttacttttacgtctacgttcgtcggtacggtaccttacgacgttcgttacgacgtactagtacgtcttacggtactttagttacgttagttcgtacgtagtttacgacgtaactacgttaccgtacgttcgttcgggtacggttcggaacggtacggaacgtaacgccgtaccggtaccgttaccgtacggtccgtacgtacccgg

SEQ ID NO: 150023 - DNA, 577 bp, Homo sapiens
  misc_feature: GYAE6OF02F2S98.33.25.C03.1.454.CMB.1.raw
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctcggtaccagcaagaacgccagatacgtccctccccggtatctcctggaggtacaggtcagactcagatacgcagcgagggctcgnggactcccagccgtcttctcgngtactccgaaggtcttcggtttccggaccaacgcgtaagggttacttttacgctattccgtcgtcgggcctacctagttcgtagacgtatggacggcttagtactagttctagttatgttagttcgactactataccgtacggtgtttggggttcgtacggggacgggtaacggacccgtaagccgttacggtacccgttcgtacgggtccacggtaccccg

SEQ ID NO: 150024 - DNA, 250 bp, Homo sapiens
  misc_feature: GYAE6OF02GS8WR.33.25.C03.1.454.CMB.1.raw
  modified_base (237)..(250): a, c, t, g, unknown or other
  misc_feature (237)..(250): n is a, c, g, or t
tcagtacacacactcacgaccggtgctcgatttagtagtgtagatttgggtttgggtgcccaagctgctggagggcacggtcaccacggtcaccgtctcctcagcttccaccaaggcccatcggtcttcccctggcgccctgctccaggagcacctctgggggcacagcggccctgggctgcctggtcaaggctacttccacgtctactgctgagcgggctggcaaaggcgcatagnnnnnnnnnnnnnn

SEQ ID NO: 150025 - DNA, 664 bp, Homo sapiens
  misc_feature: GYAE6OF02F2X10.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgccgcagtggcatcaatgttgatacctacaggatattctggtaccagcagaagccagatagtccctcccggtatctctgaggtacaggtcagactcagatacgcagcagggctcgtgggacgtccccgagccgtcttcgtcgtgggactcccgaaagggtacttcggtttccggacctaaaccggcggtaaggggtttaactttttaaccgtactaacgttccgttcggttcggggtccttacccgtaacggttccgttacgtaaccggtagtacgggtacgggtccttacggtaacttaactttacgtagttagttgttaacgttttcggacctaactagttaccgtaacgtcgtttgggggttccggttaccggggacggggtaacggggacccgtaaggtccgttacgggtaccccggtttaccggtacgggttccgaccggtaaccccgg

SEQ ID NO: 150026 - DNA, 717 bp, Homo sapiens
  misc_feature: GYAE6OF02JDJEI.33.25.C03.1.454.CMB.1.raw
  modified_base (219)..(219): a, c, t, g, unknown or other
  misc_feature (219)..(219): n is a, c, g, or t
tcagtacacacactcacgaccggtgctcgatttagtagtgtagatttgggtttgggggtcgggggtaagaggttgtgtccaccactggcctggactcctctccgtcctcctgttcctctcgtcactgcacaggttccctctccgcaggctgtgctgacgtcagccggcttccctctctgcatctcctggagcatcagccagtctcacctgcaccttgcncagtgcatcaatgttgactacctacgaggtattacttcgtggtaccagcaaggaacgaccgaagacttaaccggtccccgttacccccggttaattcccgttcccgtaggaacgggttaacctagggttaccaaggaccttcgaaagtacgtaccgacgacgcgacgggcctcggtacggtaccgtccccagcccggtctttcgtctacggactacgaaacggtcgttcggtttaccggacctaaccggtcgtaacgggtttacttttaccgtcgtacttccgttacggtcgggtcccttaccgtaggttcgtcgtaacgtacgtggtacgtgttacgtacttaacgtttacttacgttattacggttatttccggaactaacgcttaaccgtacgtttcggttagggtttccgggtacgggtaccggggtaacgggtaacccgtaacgttcggtaccggtaccgttaccggtacggttaccgaaccggtaccccggg

SEQ ID NO: 150027 - DNA, 678 bp, Homo sapiens
  misc_feature: GYAE6OF02FR8P5.33.25.C03.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcncagtggcatcaatgttgatacctagaggatattctaggtaccagcagaacnccagatagtccctcccggtatcctcctgaggtacnggtcagactcagatacgcagcagggctcgtcgggactccccgagcccgtactttcctcgtagggactacccgaaagggtactttcggtttacccggacctaaaccggcgtaaggggttaactttttaccgtactacgttccgttccggtacgggtccttacccgtaggtttcctagggaaccgtagtacgggtaggtccttaggtacttaacgtttacgtagtttagttaggttacgttttcggaccgttaactacgttacccggtacggttccggtttacggggttcggttacccggggacgggtaaacgggtaaccctaagggtcccttacgggtaccccgtttcccggtaacgggttaccaacccgggtaccccgg

SEQ ID NO: 150028 - DNA, 711 bp, Homo sapiens
  misc_feature: GYAE6OF02GLBUU.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcctaccttgcgcagtcggcatcaagttgttgactacctacgaggattattcgtaggtaccagcaagaacgccaagtagtacgtccctacccggtatcctccgtggacgtacgaggtacgacgtacacagactacgcgacgacgacggcgttcgtacggaccgtaccccgcggccgtaccttcgttcgtacgtacgtaccgttaacgggtgttaccggtttccggacccggtaaacggacgggtttaacggtaaccgttttttactaccgtactttaccgttccgtacggggtcccctacgttacgtacgtcggtaaccggtattgggaccggttcgaacgtttaaccttaacgtttacggtcgtttaatttacgggattttaccgaccgtaacttaccgtacgtacggttacggtttacgggttggggttcccgggaaccggggtaacgacccggacttcgggtaacccggtttccggtaacggtaccggttacgacccgacccggg

SEQ ID NO: 150029 - DNA, 790 bp, Homo sapiens
  misc_feature: GYAE6OF02G7VGS.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgccaccttgcgcgagtgcatacaatgttagacttacctacaggattattcgtaggtaccagcaagaacgccaagatacgtcccctcccggtatcctctggacggtacaggtacagactcgaagactacgcagcgacgggtcctcggtacggaccgtccccgaggtcccgtctttcgtcgttagggaacctacgaaacgggttcgtttaccggtttaccgggaccctaacggtacggtacgggtttaacttttaccgtactaccttaccggttacggttcgggtaccccttccggtagtttaccgtacgggtaacgttacgttacgggtaacggtccgttaacgttaaaccttttaacgtttaccgtttagggttaacgtttaggtttaaccgttttcggaaacccctttaagtaaccggttacccggttaacgggtttccggggtttttacggggggtttaacgggttttaccccggggggaaacggggttaaacccggggaacccgtttaaacgggtcccgttaaccgggtttaacccccggttccgggtttaaacgggttaccccggtaaccggtaacccccggg

SEQ ID NO: 150030 - DNA, 764 bp, Homo sapiens
  misc_feature: GYAE6OF02FQOBV.33.25.C03.1.454.CMB.1.raw
  modified_base (144)..(144): a, c, t, g, unknown or other
  misc_feature (144)..(144): n is a, c, g, or t
  modified_base (205)..(205): a, c, t, g, unknown or other
  misc_feature (205)..(205): n is a, c, g, or t
tcagtacacacactcacgaccggtgctcgatttagtagtgtagatttgggtttgggggcgggggtaaggaggttgtgtccaccatgctggactcctctcctcctcctgttctctctcactgcacaggttccctctcgcaggccngtgctgactcagccgcgttccctctctgcatctcctggagcatcagcccagtctcacctgnacccttgccgcagtggcatcaatgtttagataccctatacggattattctcggttacacggacacgaacgccgaggtaataggttaccccgttcccccggtagttccttaccgtgaacggttaaccgaggtccaaggtactccaacggtaactaaccggacgtaacggacgaacgggggtccgtacgttacgggtaaccgggttcccccaaacggtccccgtcccggtttacctttccggtacgggtaaccgttaccccgtaaagggaacggttcggttttccgggaacccgtaaccgtacggaacgggtttacgttttaccttaccgtaattcgttaccggtcgggtacctacccgtaggtcctagtaaccgagtcgaggtcgttcgtaactagtttaaccgtaggttattacggtagtttagggtacctacgtacgacgttaccggttacgtggggggtttaacggttccccggggaacgggggaaccggggttacccgaaaaggtccggttcgtaaccccgggttcctacggggttaccgtacgggtaacccccgg

SEQ ID NO: 150031 - DNA, 642 bp, Homo sapiens
  misc_feature: GYAE6OF02FY89R.33.25.C03.1.454.CMB.1.raw
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttagactacctacaggtattattcgtacggtaccagacagaacgccaagatacgtcccctacccggtatcctccgtaggagtacgaggtcagtacctacagactacgacagcgagggctcgtaggaccgtccccgagcccgtactttctcgtacggtactaccgtaaggtagtttccggtttaccggaccgtaacggcggtaacgggtttaactttttaccgactacttccgttacggtcgggtacctaccgtagttccgtgtaacgtagtcggacgtctacgtaacttacgttacgtgttacgtagttacgttggtactactagtaccgtacgttcggttagggttacggtcgggacgggtacggaccgtaaggcgttacggtacccggtacgtacggaccgaccgtaacccgg

SEQ ID NO: 150032 - DNA, 655 bp, Homo sapiens
  misc_feature: GYAE6OF02FKQ2B.33.25.C03.1.454.CMB.1.raw
  modified_base (433)..(433): a, c, t, g, unknown or other
  misc_feature (433)..(433): n is a, c, g, or t
tcagtacacacactcacgaccggtgctcgatttagtagtgtagatttgggtttgggggcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaattgttagactacctacgaggatattcgtggtaccagcagaagccaagtatacgtcccgtaccccggtattcctcctaggtacggtacaggtcacgtactcagactacgcagcgagggcctcgtgggaccgtccccacgtccgtcttcgtcgtggtacctacgaaggtacttcggttaccggaccaacggcgtagggtttacttttacncgtacttcgtcgtcggtacctccgtagttccgtagtacgtagtggacgtctagtaacttagttacgtgttacgttggttacgtttcgactacgtacgtaaccgtacgttcggtttacggggttacgggttccggggaaccggggtaacgggtaaccgtaacgggttccgttaaccgggtacccggttaccggtacgggttacccggaacccggtaaccccgg

SEQ ID NO: 150033 - DNA, 510 bp, Homo sapiens
  misc_feature: GYAE6OF01B0B75.8.24.C02.1.454.CMB.1.raw
tcagctcgcgtgtccacgaccggtgctcgatttagtacagatcgttagggaaagggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggtcttataatcatgtctcctggtaccaacagcacccggcagacgcccccaaactcatcatttatgatgtcactgactcgcccctcgaggggtttcaatcgcttctctggctccaagtctggccaacgacggcctccctgaccatctcgtgggcctccgaggctggaggacgaggctcatttattatgctagttcatatacgacagcagtactctcgtgtctcggcggaggacaagttgaccgtcaagtcacgcccagctcgccccgtggtc

SEQ ID NO: 150034 - DNA, 658 bp, Homo sapiens
  misc_feature: GYAE6OF01BSIZ4.8.24.C02.1.454.CMB.1.raw
  modified_base (191)..(191): a, c, t, g, unknown or other
  misc_feature (191)..(191): n is a, c, g, or t
  modified_base (253)..(253): a, c, t, g, unknown or other
  misc_feature (253)..(253): n is a, c, g, or t
  modified_base (283)..(283): a, c, t, g, unknown or other
  misc_feature (283)..(283): n is a, c, g, or t
tcagctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcncctggacagtccgtcaccatctcctgcactggaagcagcagtgactatttggttcttataancatgtctcctggtaccaacagccacccggnagacgaccccccaaactcatcctatttactgatcgtcactcgactccgcccctgtacgggtttcgaattccgcttcgtctggcctcacgtctggacaacgcgtccctcctcgacctacttcctcgtcggcctccgaggtctaggacgggacgtcggtctacttaagtttaatttacgttgtacgttagtttaccaacttaacgttaaccgaacccgtagtaccgaacgtcctaaccgttccgttaccgggttcggtttaccggttaccggggacgggtaaccgggtaccgttaaacgggttcccgtaaccgttacccgtaaaggtaccgtacggaccccctaaagggtccccttacccggtcccccgttaccggg

SEQ ID NO: 150035 - DNA, 599 bp, Homo sapiens
  misc_feature: GYAE6OF01A8P4B.8.24.C02.1.454.CMB.1.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (566)..(566): a, c, t, g, unknown or other
  misc_feature (566)..(566): n is a, c, g, or t
tcagctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcatggaancagcagtgacattggttcttataatcatgtctctgtaccanagccaccgnacgacgcccccaaatcatcctaatttatgatgtcactgactcgcccctagtacgggtttcacgtcgtcttcctctcggtcctccgaaggttctcggacctaacgacccggtccctcccgtagaccctattcctcggtccggtcctccggaagggtcctagggaacggaaccggacggctacgttaatttagttagttcgacttagttactagtacgaaccgtcacgtacagcctagtccgtcgtacggtcctcggggacggtacggacgtagttcggacccgttacgtaanccgtacgacccaaggccctccgcccccgtacgg

SEQ ID NO: 150036 - DNA, 702 bp, Homo sapiens
  misc_feature: GYAE6OF01EA3YR.8.24.C02.1.454.CMB.1.raw
tcagctcgcgtgtccacgaccggtgctcgatttagtacagatcgttaggggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatcctcctgcactggaagcagcagtgactattggttcttataatcatgtctcctggtaccaacacgaccacccggcacgacgaccccccaaaactcatctatttatgatcgtcactgactcccgcccctacggtacggggtttaccaacgttccgtcttctcgtcggctacctaagtctaggaccaaccgaccggtcccctacccgtcgaccctacttccgtcgtacggggcctccgaggtctagggacgggacgacgggtcctacgttaatttactttagttcgacgttacggtttacaacgttaacgtaacccgaacctacggtacctaacggacccttaaccgtcccgttacggttccgggttcccggtttaccggggacggggtaaccgggtaacccgttaagggttcccgggtaacccgttacccgtaaaacggttcccgaaccggtaaccccgaacgggtccccttacccggtccccccgttacgg

SEQ ID NO: 150037 - DNA, 751 bp, Homo sapiens
  misc_feature: GYAE6OF01D5VZ7.8.24.C02.1.454.CMB.1.raw
  modified_base (194)..(194): a, c, t, g, unknown or other
  misc_feature (194)..(194): n is a, c, g, or t
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
  modified_base (733)..(733): a, c, t, g, unknown or other
  misc_feature (733)..(733): n is a, c, g, or t
tcagctcgcgtgtccacgaccggtgctcgatttagtacagatcgttagggaaaggggggggtctcaggaggcagcgctctcgggacgtctccaccatggcctgggctctgttattcctcaccctcctcactcagggcacgacgggtccagggcccaatctgccctgactcagcctgcctcgtgtcgtgggtccncctggacacgtccgtcacctatcctccgtgcaacgtgggaacgcacgcagtcgactagtttggttacttaataactcagtnttcctcgtacggtaaccaacgacgcccgaccgcacgaccaccccgaaatctactcgtatttacgngtactcgtactacgtacgtacgtcccgtaccgttacggttaagggtttaccgtaacgttccgtacgtttcctacggttcggtacctacccgtacgtcggtaccggtacgaaaccggtcccggtccctaccgtacgaccctacgttccgtcggtacgggtcctaccggtaggtccgacggtaacgggtacggtaccggttcgttacctttagtttaacgtttcggttcgtaactttacggttactaagttaccgtaaccgacgtacgaccgtaacggcccttaacgtccggttaccggtgggttaccgtaccggggaccggtaacgggtaccgttaagggttaccgtacccggttaactaccggttacgaacccggtacccgtaccgggtcccncccgttccccggtcccgg

SEQ ID NO: 150038 - DNA, 754 bp, Homo sapiens
  misc_feature: GYAE6OF01AT7BO.8.24.C02.1.454.CMB.1.raw
  modified_base (190)..(190): a, c, t, g, unknown or other
  misc_feature (190)..(190): n is a, c, g, or t
  modified_base (308)..(308): a, c, t, g, unknown or other
  misc_feature (308)..(308): n is a, c, g, or t
tcagctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccaggcccaatctgccctgactcagcctgcctccgtgtctgggtcncctggacagtccgtcaccatctcctgcactggaagcagcagtgacatttggttcttatatcatgtctcctggtaccaacagccacccggcagaccgcccccaaactcatctatttacngtactgtccactgactcccgccccgttgtacgggggtttacaacttccggtcctttcgttccgttacgggcccttacccgtaaaggttccgtacggacctaaaccggaccccgggtccccttacccgtacggaacccctacgttacccgttccggtcggggtacccgtacccggacgggtacccgtacgggaaccgggtaacgggtaccggtccttaaccgttaatttaacgtttacgttacgtactacgtttactaacttaacgttaacccgaaccgtacggaccgtaacgtactacccttaccgttccgggttcggttccggttaccgggtaccggggtaacggggtacccttaagggttacccggaaccccgtttacccgtaaacggtacccgtaaccggaccccggtaaaggtccccgtacccgggtcccccgttacccggg

SEQ ID NO: 150039 - DNA, 757 bp, Homo sapiens
  misc_feature: GYAE6OF01AT6YN.8.24.C02.1.454.CMB.1.raw
  modified_base (242)..(242): a, c, t, g, unknown or other
  misc_feature (242)..(242): n is a, c, g, or t
  modified_base (637)..(637): a, c, t, g, unknown or other
  misc_feature (637)..(637): n is a, c, g, or t
tcagctcgcgtgtccacgaccggtgctcgatttagtacagatcgttagggaaaggggggggtctcagggaggcagcgctctcggggacgtctccgaaccatgggcctgggctctgttattcctcaccctcctcactcagggcacagggtccagggcccaatcgtgccctgactcacgcctgcctccgtgtcgtgggtccacctggactgtccgtcaccactctccgtgctacgtagggaacnctagcgagtgacctatttcggttacttaataactctatcgtctacgtacgtaccaacgcgacccgaccgactacggacccaacccctaaactctaactacttaacgttatacgtaactcgtacgtaccgtcgaacctccggacccgttagtacggggtttacaccgttccgtcgttaccgtcgtacggaccgttacgtacggttcggaaccggtaccaacccggtacccggtaccctacccgtacggtaaccctaccgttcgtacgggtaccggtccctaacggcggttacccgtaacggggtacggaaaccggtcgggttacctaacgtttaaagtttcgttactccggtacttaaccggttacaattaccgaaaccgtcgaaccggtccgtanccgttaacgtccggttacggtcggttaccgtaccggggaccggtaacggtacggttacgttaacggtcccgtaactacgtacggacccggtacgacggtccctccccgggtaccctccgg

SEQ ID NO: 150040 - DNA, 571 bp, Homo sapiens
  misc_feature: GYAE6OF02F90QW.8.24.C02.1.454.CMB.1.raw
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagccacccccggcagacgaccccccaaactcatcatttangatgtcactgatccgcccctgtaggggtttcaatcgcttctctgcctcaagtcnggcaacacgccctccncgaccatctcgtgggcctccgagggctggacgggaccgaggcctacgtaatttattacgttgtactagtttacaattactaccgaccagccaagtccaattcgtcggttcgtccgttcgggacgggacgggtaaccaaggttcgaacccgttcgtaagtcacggtcccgaaggcctaccgcccccgtcgg

SEQ ID NO: 150041 - DNA, 506 bp, Homo sapiens
  misc_feature: GYAE6OF02H59Z6.8.24.C02.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagacgcccccaaactcatcatttangatgtcactgatcgccctgaggggtttcaatcgcttctctggctcaatctggcaacacgcctccngaccatctctggctcgagctgagacgaggctcattatattgctagtcatactacgacagcagcactctcgtgtcgttcggcggacggactaagttcgaccgtcgtaagtcacgcccaaggcctccgcccctcgg

SEQ ID NO: 150042 - DNA, 535 bp, Homo sapiens
  misc_feature: GYAE6OF02F9OQJ.8.24.C02.1.454.CMB.1.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagccaccccggnagacgcccccaaatcatctatttatgatgtcactgactccgccctcgaggggtttcaatcgcttctctggctcaagtctggacaacnccggcctccctgacctatctcgtgggctccgaggctggacggacgnggctctatttattattgctagttcatatacgacagcagctactctcgtcgttcgtcgggcggacgggactaaggttcgacccgttactaagtccacggcccgagccgtccgcccctcgg

SEQ ID NO: 150043 - DNA, 777 bp, Homo sapiens
  misc_feature: GYAE6OF02IYNT9.8.24.C02.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagctcgcgtgtccacgaccggtgctcgatttagtacagatcgttagggaaagggggggggtcgtcgagggaggcgagcgctctcgggacgtctccaccatggcctgggctctgttattcctcaccctcctcactcagggcacagggtccagggcccaatctgccctgactcagcctgcctcgtgtctgggtcgcctggacngtccgtcaccatcctcctgcacgtggaacgcagccagtgactagttggtttctaataatcatgtctcctaggtacaacagccaccccggnacgaccgaccccctaaaactccaactctatttactacgtattcggtactacgtgtacttcccgccccgttgtaacgggggttttaccaagttccgtactttctacgtcggtcctaccgtaagttccgtaggactaaccgtaccggtcccctccctcggtacccgttctccggtacgggcccttcccgaagttacccggtaggtaaacgggcttacggggacggtacctttacgggtaaattttaacgtttaccgacggttaccaacggtacccttacgttaactttaaccgttcgacggggaacctacgtaaccgtaaacgggtacggggtttaaccttccggggggaaccgggtaagggtaaacccgtaaggggttttaaccccggaacccggtttccgggttaaaccgggtcctaaccggggccccgtttaaaccggggcctttaccccgggaccccccgtttacgggttaccccgtaccgg

SEQ ID NO: 150044 - DNA, 625 bp, Homo sapiens
  misc_feature: GYAE6OF02F5BMO.8.24.C02.1.454.CMB.1.raw
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagccaccccggcagacgaccccccaaactcatctatttatgatgtcactgactccgcccctgtaggggtttcaagttcgcttctctcggtcctccaagtcgtacggacaacgaccggccctcccgtcgaccctatccgtacgtcgggccttccgacggtctagggaacgggaccgaggtcctacgtaattttagtttattcgacttagttactaattactaccgacacgaccacgcctacttcgtcgttacgggttcgtaccgggacgggacggtaaccgtaacggttaccgtaacccggttaccgtaagtccgacggacccgaaggtcccgttaccggtcccccgttaccggg

SEQ ID NO: 150045 - DNA, 572 bp, Homo sapiens
  misc_feature: GYAE6OF02G8OL2.8.24.C02.1.454.CMB.1.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttanaatcatgtctctggtaccaacagccaccccggnacgacgacccccaaactcatcatttangatgtacactgactccgcccctcgagggggtttcaatcgtcttctctggctaccaagtctggacaacnccggcctcctgaccatcctcgtcgggcctccgaggctagagggacgaggctactatttattagttcgactagttaccattactaaccgacctaagccaagcctactctcgtgttccgttcgggcggtaacggtacctaagttccgaacccgttacgtaacgccgacgcccgaaggtccgtcccgtcccccgtcgg

SEQ ID NO: 150046 - DNA, 780 bp, Homo sapiens
  misc_feature: GYAE6OF02HEN9W.8.24.C02.1.454.CMB.1.raw
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagccaccccggcacgacgaccccccaaatcatccatttatgatgtcactgactccgcccctcgtacggggtttacgaacttccgctttccgtcgttcggccttccgaagttcctacgggacctaaaccgtaccggtccctcccgtacgaaccctacgttcctaccggtcggggtcccttacccggaagggtcccttaggggaaccgggaccgggtacggtcccttacgttaaacgtttttaactttacgtttacgccgttaacggtttactaacggtttaaacctaacccggaacccgttaacgaccgttaacggcccgttaaccgttccgttaccgggtttccgggtttaccgggtttccgggggaccggggttaaaccggggtaaccccgttaaagggttttacccgggtaaccccggtttaacccgttaaacggttcccggtaacccgggtaacccccgtaaaggggttcccccgttaccccgggttaccccccccgtttacgggg

SEQ ID NO: 150047 - DNA, 638 bp, Homo sapiens
  misc_feature: GYAE6OF02JY60W.8.24.C02.1.454.CMB.1.raw
  modified_base (226)..(226): a, c, t, g, unknown or other
  misc_feature (226)..(226): n is a, c, g, or t
tcagctcgcgtgtccacgaccggtgctcgatttagtacagatcgttagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaancagcagtgattacaactatatctcctaggtaccaacaacacccaggacaaacgccccaaactcatcgtattttgaggtacaataacgcggaccctagacggggtccctgactcgtacttcgtcaggtcctaccaagtcgtacggacaacgaccggtccctcccgtagacccgttctacgtcgggcctccacgaccgtaggacggtatacggacggtctagtaactttagttaacgtcgactagtcttactattacttccgaggtacagaaccgaacggtagggtacgttacgggacgggtacggtaacctaaggttcgaaccgttcgtaaggtccgtaacgacccggaaggtcctcccggtaccccgtcggtaccaccttccgtcccgttcccctacttcccgaccgacccg

SEQ ID NO: 150048 - DNA, 611 bp, Homo sapiens
  misc_feature: GYAE6OF02JWFNS.8.24.C02.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (420)..(420): a, c, t, g, unknown or other
  misc_feature (420)..(420): n is a, c, g, or t
tcagctcgcgtgtccacgaccggtgctcgatttagtacagatcgttagggaaagggggggggtcgtcaggaggcagcgctctcaggacgtcaccaccatgcctgggctctgctcctcctcaccctcctcactcaggcacagggtcctgggcccagtctcgccctgactcagccctccctccgcgtccgggtctcctggacngtcagtccaccatcctcctgccacgtggacnccagcagtnacttacaactntactcttcctgtaccaacaacaccagacaacgaccccaaactcatacgtatttacgagtacaataagcgcctacgacgggtcctgactcgcttctcgacgtctaccgagtctcgacacaccggcctccgcgtaccgtctcgtcggcctcgacgagtggacgtctcggnggtctagtactttatacgtgctacgctactacttagtacgcgtaacacgtacgaaacggtgggtaacgttacgggacgggtaaccgggtaacgtaaggtttccgacccggtttccgaggtacctacggaaccgtacgccgtcccgacccgttcgtacctacgtccgttaccttacccgtccctcgtaaccg

SEQ ID NO: 150049 - DNA, 556 bp, Homo sapiens
  misc_feature: GYAE6OF02FMLP8.8.24.C02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacngtccgtcaccatctcctgcactggaagcagcagtgacatttggttcttataatcatgtctcctggtaccaacagccaccccggnagacgacccccaaatcatcatttangatgtcactgactccgcccctgtaggggttcaatcgcttctcgtgctcagtctggacaacncgcctccngacatctcgtggcctccgagtctggacgacgagctctattattagtgctagttcaattacacgacctagcagcctacttcgtccggtggttaccgtcgggacggtacgggaaccttaaggttccgaccgttacctaacggtccaaccggcccgaagggtcctacccggtccccctcgg

SEQ ID NO: 150050 - DNA, 743 bp, Homo sapiens
  misc_feature: GYAE6OF02JVEQL.8.24.C02.1.454.CMB.1.raw
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctccctccgcgtccgggtctccgtggacagtcagtcaccatctcctgcactggacgccagcagtgattaacaactatactctccgtacggtaaccaacaaccacccaggaccaaacgacccccaaactcatgttattttaggacggtacaacgtaacggccggtaccctcggaacggggttccctaggacgttccgtacctttcgtaccgacggtccctaccgtaacgttccgtacggaccaaacccgaccgggtcccccttacccggtacggtaacccgtttccggttccggttccggggtacccttacccggtaaccgtaccggttacgggaacgggtacgtacgggaacggtcgttaacgggtacttttaaacgttcccgtaggtacgtaacggtccttaacgtacgttaacttcggaacgtcgaacgtaccgtaacggtacgggttacgtcgggacggacgggtaaccgtaagtccgaacccgttagtacggacgaccgtacgacggtcctaccggccctacggtctaccgttccgtaccgtcccctacgtccgtccgaccgtacgg

SEQ ID NO: 150051 - DNA, 522 bp, Homo sapiens
  misc_feature: GYAE6OF02IFZSL.8.24.C02.1.454.CMB.1.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctctggtaccaacagcaccccggnagacgcccccaaatcatcatttangatgtcactgactccgcccctgtaggggtttcaatcgcttcntgctcagtcngcaacncgcctccngaccatctctgggcctcgaggctgacggacgaggctacgtatttatattcgctagtcatactacgaccagcagtcactcgtgtgtcttcgggacggtacggactaagtcgaccgttactaagtcacgcccgaaggtcctccgccccgtcgg

SEQ ID NO: 150052 - DNA, 701 bp, Homo sapiens
  misc_feature: GYAE6OF02IN4H1.8.24.C02.1.454.CMB.1.raw
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
tcagctcgcgtgtccacgaccggtgctcgatttagtacagatcgttagggaaagggggggggtcgtcgaggaggcagcgctctcgggacgtctccaccatggcctgggctctgttattcctcaccctcctcactcagggcacgagggtccgacgggcccaatctgccctgactcagcctgcctccgtgtcgtgggtccgccgtggaaacgtccgtcaccatctcctgcactggaancagcagtgactattggttcttataatcatgtctcgtgtaccaacacgccacccggnacgaccgacccccaaacnccaactctatttangtatcgtcactgactccgacccgtcgtacgggttacgaacttcgtcttctcgtcgtcctacacggtcgtacggacctaacgacccgtcccttacccgtacgacctacgttcgtccggcggtacctccgacgggtcgtacgggaacgggacgtcggtacctacgttaagtttaacgtttcgtacgtacgtaacgtttcctaaacttacgtaacccggaactcggaactaaccgtccgttaaccgttcgtttacgggttacccggttcgggtacccggggagggaaccggttaccggtaaacggtttccggaacccgtttaccgtaaaggcccgtacggaccccggtaggttcccgacccggtccccgttaggtacccc

SEQ ID NO: 150053 - DNA, 764 bp, Homo sapiens
  misc_feature: GYAE6OF02HTWTQ.8.24.C02.1.454.CMB.1.raw
  modified_base (75)..(75): a, c, t, g, unknown or other
  misc_feature (75)..(75): n is a, c, g, or t
  modified_base (118)..(118): a, c, t, g, unknown or other
  misc_feature (118)..(118): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
tcagctcgcgtgtccacgaccggtgctcgatttagtacagatcgttaggaagggggggtctcaggaggcagcgcnctcgggacgtctccaccgatggcctgggctctgttacttcctnaccctctcactcagggtcacacgggtccaggcccaatctcgccctagactcgagtcctcgtccgtccgtgtctggggtccacctgggaccagttccgtccacgattcctccngccacgtgganccaggccagtgaactagtttcggtacttaagtaactcgtaagttcgttcttacgtacggtaaccaacgtacggaccgtacccccggacaaccggaccggtaacccccctaaacgtacctacgtaaccgtttaacttttacgtagtaaccgttcgttaccgaccgttacgttacccgttacccgtccccgtttaaggttacccgggggtttacacggttaccgtcgtttaccgtcggtacgtacctacgtaacgtcgttacggacttaaccgccgtccttacccgacgtactactccgacgtcggacgtccgacggtcgtagacggtacgtcgacgtacttaagtttacgtnttaccggntaacggtcttaacgaactacgtaccggatccgtaacgtaccgtcgtcggttaaccgttcgcccggtaagccgttaacggaacgtttaccggtaaccgtaaccgttaagtacccggacgttaaccccgtgggtaacccttacccgggtaccccttacggttaccg

SEQ ID NO: 150054 - DNA, 691 bp, Homo sapiens
  misc_feature: GYAE6OF02ILEJE.8.24.C02.1.454.CMB.1.raw
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (552)..(552): a, c, t, g, unknown or other
  misc_feature (552)..(552): n is a, c, g, or t
tcagctcgcgtgtccacgaccggtgctcgatttagtacagatcgttagggaaaggggggggggtcgtcaggaggcgagcgctctcgggacggtctccaccatggcctgggctctgttattcctcaccctcctcactcagggcacgagggtccagggcccaatcgtgccctgactcagcctncctccgtgtctgggtcnccgtggacagtccgtcacatctcctgcacgtggaagcagcagtgacattcggttctataatctatgtctactggtaaccaactagccaccccgganacgaccgaccccaaactccatcctattatcgtatntacgtctgaactcccgacccttacggacggggttacgtaacgtcgtccgttctacgtacgtccgtactaacgtcgtacgaccgtactacgccgtccccgtacgcgtaactcgttcgtacggaccgtcgtaccgacggtacgacggtacggacgtcgtactactttaaggttacttgtacgtactacgtacttaacggtacctaaccgacgtaccgaagttccnccgttaacgtccgttacgttcgggtaccgggtcgggtaccggggtaaactaaccgggttaccggtaacccggttaccgtaagtaccggtaaccgtcccgggtaaaccgtttcccgacccggggtacccccgttccccgg

SEQ ID NO: 150055 - DNA, 897 bp, Homo sapiens
  misc_feature: GYAE6OF02HCPZ5.8.24.C02.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagctcgcgtgtccacgaccggtgctcgatttagtacagatcgttagggaaaggggggggggtctcaggaggcagcgctctcgggacgtctccaccatggcctgggctctgttattcctcaccctcctcactcagggcacgagggtccagggcccaatcctcgccctagactcacgcctgcctccggtgtcgtgggtcnccgtggacacggtccgtccaccacttcctccgtgcacgtaggaacncagcaggtacgacttagtttcggtttacttaataactctattcgttccttccgttacggtaacccaacgacggacccacccccgggacaacggacccgaaccccccaaacctacgaactttacctaattttaacgtacgtaactcggtacctacgtaggtacccttacccgtaccccgttagggttaaccggggtttacgaaccgttccgttcctttccgtcgtccggtaccgtaccgtacgttcgtacggaccctaaccgtaccccggttcccttacccgtacggaacccttagttaccccggttccggtccgggtcccctaccggacggttacggtacgggacgggtacgggtccgtacgttacgttaactttttagttaacttcggtactttaacggttacgtaaacttaaccggtaacccgtaacgtacgaacccgtaacgtcccttaccggttaaccgttccgggttaccgggttacccgggttacgggggacccggggtaaaccgggttaaccgggttaacgggttacccgggttaaccccgggtttaaccggtttacccggaaaccccggggttacccgtaaaccccgggggttaaccccggtttaccccgggtttacccccgggtaccccccggtttccccgg

SEQ ID NO: 150056 - DNA, 790 bp, Homo sapiens
  misc_feature: GYAE6OF02H9X1T.8.24.C02.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (332)..(332): a, c, t, g, unknown or other
  misc_feature (332)..(332): n is a, c, g, or t
tcagctcgcgtgtccacgaccggtgctcgatttagtacagatcgttagggaaaggggggggggtctcaggaggcagcgctctcgggacgtctccaccatggcctgggctctgttattcctcaccctcctcactcagggcacagggtccagggcccaatctgccctgactcagcctgcctcgtgtctgggtcncctggacngtccgtcaccatcctcctgcacgtggaancagcagtgactagtttggttctaatatctatcgttctccgtaggtaaccaacacgaccgaccccggcacggaccaccccctaaactctacttactattttacngtatcgtactacgtgaccgtcccgacccgttacggtacggggttacgtaacgtcgtcctttaccgtgtaccggtccttaccgtaacggttcgtacggaccgaaccgacccggtcccttacccgtacgtacccttacgttccgttaccggtaccggggtccctaccgggtacggtacggtagggaaccgggtaacgtacgggttacccttaacgttaagttttaacgtttacgttcgtaccgttaacggttaacctaacgttaaaccgtaccggtacacggtactaacgtacccttaccgttaccggttcgggttacggggttcccggttaccgggggaccggggttaacgggtaacccgtttaacgggttcccggttaaccccggttaacgtaaccggttcccggaaccggtaccccgggtaacggtaccccggttcccccgggaccccgttacccgg

SEQ ID NO: 150057 - DNA, 720 bp, Homo sapiens
  misc_feature: GYAE6OF01A9OX0.42.20.B09.1.454.CMB.1.raw
  modified_base (593)..(593): a, c, t, g, unknown or other
  misc_feature (593)..(593): n is a, c, g, or t
tcagtgacgtatgtcacgaccggtgctcgatttagtgtagtgtgaagggtaaagggggggtaggaggacgcccagcactgggagttccgaggtgtttccattcggtgagtcagcactgaacacagacgactcaccatggagttttggctgagcgtggtttcctgtgctagtttaaaggtgtctagtgtgaggtgcagctaggtggtagtctggaggaggtccgttaggaagcgagaccggtcgggggtccctgacgtcctccgtcctgtcgcacgccgtcgtgggttccaccgttccaggtcacctaactacagtcgacgcgtcggggtcccggccaggtccgtaccggagggggaacggggccggtaggtcgggtctacgtaagtttacttagtcggacggtagaaactactactacgtacgcgacgacgttacggaggaacgggccgtattaccgactattccgacgagactacctaagttacgaaagaactactagttcgtaccttacttaacaaagtacgaactacgcccgtaaggacggaacgacccggtaaggaccgtacggggcccgtttaagtaacgtttaccgnggtaccggacggtaagggtcggttacccgtaacgggtaaaggttcggtactttacggttcggtaactttcgtttaacggaacccgttaacggggccggggtaacccgtaaccgggggttaaaccccg

SEQ ID NO: 150058 - DNA, 815 bp, Homo sapiens
  misc_feature: GYAE6OF01EDQD0.42.20.B09.1.454.CMB.1.raw
tcagtgacgtatgtcacgaccggtgctcgatttagtgtagtgtgagggtaaagggggggtaggaggacgcccagtcgacgtggggttagttccggagggtcgtttccattccggtcgaatcagccaacgtgaacaccagacggacttcacctactcggtagttttggctgagtcgttgggtttttccttgttggtcttagttttaaaaggtgtccagtgtgaggtgcagctggtggagtcgtggaggaggcttagaagcaggccgtcggggggtccctgacgtactcctccgtgtgcacgcctcgtcgggttaccaccgtcgagtacgacaactacatgagcgtcgggtcccgcgacggccgtaccggagggggaacggggccggaggtcgggtctacgtagttttatttagtgggtacggtacgaaactacaacttaccgtaacgacgaacgtaccgttccggtaggaacgggtcccgtacttccgaacctacttacccgtaccgaggtaaccgtaccttaagttaacggaaaacgtaaacctacttaacgttttcgtaccttacctttaacgaaaattccggaaaactccggtcctaagggaacgtacggacccggtaaggacccgtaccgggtaccgtttaggtttaacttaccgtagggtcgtaaccggagggttacggttaccgttaacggggtaaacggtttcgggaacccttttacggggttcgtaacccgtttaaggtttttaccgggaaacccgttttaccgggggtaccgggggtacccccgaaacgggggtttaaaccccccgg

SEQ ID NO: 150059 - DNA, 741 bp, Homo sapiens
  misc_feature: GYAE6OF01ADMZV.42.20.B09.1.454.CMB.1.raw
tcagtgacgtatgtcacgaccggtgctcgatttagtgtagtgtgagggaagggggaggaggagccagcactggattccgaggtgttccattcggtgatcagcactgacacagaggactcaccatggagttttggctgagctgggtttccttgttgcttattttaaaggtgtctagtgtgtagtgcagtctggtggagtctggaggaggcttgaagtcagcccgtggggggtccctagacgacgtctccgtgtgcctagcctctgggttccaccgtcagtagcaacttacagtgagtctcgggtcccgaccgacggtcctcgaacgggggaacggggcgaggtcgggtctacgtagttattacgtgggacgtagtaaccgtacaacttacgacgacgtagtacctcggtagaacggggccgtaattcccaaccgtactccttacgacgtacaacccttagttacccggaaagtaaaccccattaactttcggtaccctaacgtttacaaaaacttcgaaacccgtacggtccctaagggaacggaggaccccccgggaaagggacccctaacccggggtaccgtttaccgttaacgtttaccgtaggcggttacccggaaaggttacccgggtaacctcggggtaaaacggttccgggtaacgtttcggttaccaaagttttcccggttaggtacggtaaacccggtccggggggtaaacccgacggtttaacccccccggg

SEQ ID NO: 150060 - DNA, 292 bp, Homo sapiens
  misc_feature: GYAE6OF01DL674.16.60.F05.1.454.CMB.1.raw
  modified_base (286)..(292): a, c, t, g, unknown or other
  misc_feature (286)..(292): n is a, c, g, or t
tcagtgtactactccacgaccggtgctcgatttagtacgtcatcagggaaagggggtcccatcaaggttcagcggcaatgcatctgggacagatttcactctcaccatcagcagcctgcagcctgaagattttgctaacttttttctgccaacagtatattctttaccctccgactttcggcggagggaccagggttgagatcaaacgaactgtggctgcaccatctgtcttcatcttcccgccatctgagagtagtacactgagcgggctggcaaggcgcatagnnnnnnn

SEQ ID NO: 150061 - DNA, 298 bp, Homo sapiens
  misc_feature: GYAE6OF02H6GA7.16.60.F05.1.454.CMB.1.raw
  modified_base (149)..(149): a, c, t, g, unknown or other
  misc_feature (149)..(149): n is a, c, g, or t
  modified_base (290)..(298): a, c, t, g, unknown or other
  misc_feature (290)..(298): n is a, c, g, or t
tcagtgtactactccacgaccggtgctcgatttagtacgtcatcagggaaaggggggtcccatcaaggttcagcggcaatgcatctgggacagatttcactctcaccatcagcagcctgcagcctgaagattttgctaactttttttcngccaacagtatattcttaccctccgactttcggcggaggaccagggttgagatcaaacgaactgtggctgcaccatctgtcttcatcttcccgccatctgagtagtagtacactggacgcgggctggacaaggcgcatagnnnnnnnnn

SEQ ID NO: 150062 - DNA, 212 bp, Homo sapiens
  misc_feature: GYAE6OF01EAH3A.34.60.F05.1.454.CMB.1.raw
  modified_base (209)..(212): a, c, t, g, unknown or other
  misc_feature (209)..(212): n is a, c, g, or t
tcagtacacgtgatcacgaccggtgctcgatttagtacgtcatcagggaaagggaccgcggtcgccgtctcttcagcctccaccaagggcccatcggtcttcccctggcaccctcctccaagagcacctctggggcacagcggccctgggctgcctggtcaaggactacttccatcacgtgtactgagcgggctggcaaggcgcatagnnnn

SEQ ID NO: 150063 - DNA, 380 bp, Homo sapiens
  misc_feature: GYAE6OF01ANVB4.34.60.F05.1.454.CMB.1.raw
  modified_base (373)..(380): a, c, t, g, unknown or other
  misc_feature (373)..(380): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggacgccgtctcttcagcctccaccaagggcccatcggtcttccccctggcaccctcctccaagagcacctctgggggcacagcggccctgggctgcctggtcaaggctacttccatcacgtgtactgagcgggctggcaaggcgcatagnnnnnnnn

SEQ ID NO: 150064 - DNA, 215 bp, Homo sapiens
  misc_feature: GYAE6OF01DFTNO.34.60.F05.1.454.CMB.1.raw
  modified_base (211)..(215): a, c, t, g, unknown or other
  misc_feature (211)..(215): n is a, c, g, or t
tcagtacacgtgatcacgaccggtgctcgatttagtacgtcatcagggaaaggggaccgcggtcgccgtctcttcagcctccaccaagggcccatcggtcttcccctggcaccctcctccaagagcacctctgggggcacagcggccctgggctgcctggtcaaggactacttccatcacgtgtactgagcgggctggcaaggcgcatagnnnnn

SEQ ID NO: 150065 - DNA, 348 bp, Homo sapiens
  misc_feature: GYAE6OF01BCQBI.34.60.F05.1.454.CMB.1.raw
  modified_base (346)..(348): a, c, t, g, unknown or other
  misc_feature (346)..(348): n is a, c, g, or t
tcagtacacgtgatcacgaccggtgctcgatttagtacgtcatcagggaaagggccgattcacccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggactacttccatcacgtgtactgagcgggctggcaaggcgcatagnnn

SEQ ID NO: 150066 - DNA, 440 bp, Homo sapiens
  misc_feature: GYAE6OF01C9SAX.34.60.F05.1.454.CMB.1.raw
  modified_base (436)..(440): a, c, t, g, unknown or other
  misc_feature (436)..(440): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccttctcttcagcctccaccaagggcccatcggtcttccccctggcaccctcctccaagagcacctctggggcacagcgccctgggctgcctggtcaaggctactccatcacgtgtactgagcgggctggcaaggcgcatagnnnnn

SEQ ID NO: 150067 - DNA, 442 bp, Homo sapiens
  misc_feature: GYAE6OF01A5KXR.34.60.F05.1.454.CMB.1.raw
  modified_base (439)..(442): a, c, t, g, unknown or other
  misc_feature (439)..(442): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttccccctggcaccctcctccaagagcacctctggggcacagcggccctgggctgcctggtcaaggactacttccatcacgtgtactgagcgggctggcaaggcgcatagnnnn

SEQ ID NO: 150068 - DNA, 215 bp, Homo sapiens; identical to SEQ ID NO: 150064
  misc_feature: GYAE6OF01CUQ3T.34.60.F05.1.454.CMB.1.raw
  modified_base (211)..(215): a, c, t, g, unknown or other
  misc_feature (211)..(215): n is a, c, g, or t

SEQ ID NO: 150069 - DNA, 377 bp, Homo sapiens
  misc_feature: GYAE6OF01DYH3N.34.60.F05.1.454.CMB.1.raw
  modified_base (372)..(377): a, c, t, g, unknown or other
  misc_feature (372)..(377): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttcccctggcaccctcctccaagagcacctctgggggcacagcggccctgggctgcctggtcaaggactactccatcacgtgtactgagcgggctggcaaggcgcatagnnnnnn

SEQ ID NO: 150070 - DNA, 446 bp, Homo sapiens
  misc_feature: GYAE6OF01C7JA5.34.60.F05.1.454.CMB.1.raw
  modified_base (440)..(446): a, c, t, g, unknown or other
  misc_feature (440)..(446): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactttgcgagagagccccaccgctcatttgcctcggggacttattattactacggtctggacgtctggggcaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnnnn

SEQ ID NO: 150071 - DNA, 447 bp, Homo sapiens
  misc_feature: GYAE6OF01BK2BM.34.60.F05.1.454.CMB.1.raw
  modified_base (439)..(447): a, c, t, g, unknown or other
  misc_feature (439)..(447): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttccccctggcaccctcctccaagagcacctctggggcacagcggccctgggctgcctggtcaaggactacttccatcacgtgtactgagcgggctggcaaggcgcatagnnnnnnnnn

SEQ ID NO: 150072 - DNA, 213 bp, Homo sapiens
  misc_feature: GYAE6OF01B7A27.34.60.F05.1.454.CMB.1.raw
  modified_base (212)..(213): a, c, t, g, unknown or other
  misc_feature (212)..(213): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnn

SEQ ID NO: 150073 - DNA, 712 bp, Homo sapiens
  misc_feature: GYAE6OF01E55DL.34.60.F05.1.454.CMB.1.raw
  modified_base (295)..(295): a, c, t, g, unknown or other
  misc_feature (295)..(295): n is a, c, g, or t
  modified_base (619)..(619): a, c, t, g, unknown or other
  misc_feature (619)..(619): n is a, c, g, or t
  modified_base (628)..(628): a, c, t, g, unknown or other
  misc_feature (628)..(628): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaaggccgattcaccatctccagagacaacgccaagaactcacttatttctacaaattgaaacgcctgagagtcgaggacacaggtgtttattactgtgcgagagacgccccaccgctcgatttcgccgtcgggtaccttagttattactacggttctggacgtctggggcaaggggaccncggtcgccgtctcttcacgcctccgaccgaacggcccacgtccggtccgttcccccgtgggccctaccccgtccgtacccgaacggtacgccgtaacccgttcgttcggggggccaccgtaacgggcccggaccccgttcggggtaccttcggcccgtttacgggtacccgtaaaacggggtacccctttaaccggtttaccccgaacgtttacccgaacccgggtttacggttacccgttaggggaaacgggtccccggggtaacgttacggggacccgtaaaacgggtcccgaccgtaaacgttaggactgaccttagaccncgagaccgngacgacgacgacgacgacgacgtacgtcgtacgtcgacgcgacgacgacgacgacgtacgtacgacgtacgacgtcgtcgtacg

SEQ ID NO: 150074 - DNA, 446 bp, Homo sapiens
  misc_feature: GYAE6OF01DFVPK.34.60.F05.1.454.CMB.1.raw
  modified_base (438)..(446): a, c, t, g, unknown or other
  misc_feature (438)..(446): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcctcagcctccaccaaggcccatcggtctcccctggcacccctcctccaagacgcacctctggggcacagcggccctgggctgcctggtcaaggacctactccatcacgtgtactgagcgggctggcaaggcgcatagnnnnnnnnn

SEQ ID NO: 150075 - DNA, 544 bp, Homo sapiens
  misc_feature: GYAE6OF01ECKA7.34.60.F05.1.454.CMB.1.raw
  modified_base (346)..(346): a, c, t, g, unknown or other
  misc_feature (346)..(346): n is a, c, g, or t
  modified_base (509)..(509): a, c, t, g, unknown or other
  misc_feature (509)..(509): n is a, c, g, or t
  modified_base (513)..(515): a, c, t, g, unknown or other
  misc_feature (513)..(515): n is a, c, g, or t
  modified_base (517)..(518): a, c, t, g, unknown or other
  misc_feature (517)..(518): n is a, c, g, or t
  modified_base (520)..(544): a, c, t, g, unknown or other
  misc_feature (520)..(544): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatatctgcaaatgaacagtctgagagccgaggacacggctgtctattactgtgcaagaggtgctacaatcattggttttgatctcgtggggccaaagggacaagtggtccaccgtctcttcacgccctccaccgaacgggcccagttccggtcccttcccccgtggccgcccctgcctccgaggacnccaccgtccgagacgcacgacggcccggcccgtggggcctcggcccgttagggtaccgaaacggtaccctttaaccttcccaacgttccgtaaccggttcgtaaccgtgggaacgggcccggggtactcggggaccgtaaacggggcccgacctaaggtacgngacnnngnncnnnnnnnnnnnnnnnnnnnnnnnnn

SEQ ID NO: 150076 - DNA, 714 bp, Homo sapiens
  misc_feature: GYAE6OF01CIG9B.34.60.F05.1.454.CMB.1.raw
  modified_base (452)..(452): a, c, t, g, unknown or other
  misc_feature (452)..(452): n is a, c, g, or t
tcagtacacgtgatcacgaccggtgctcgatttagtacgtcatcagggaaagggggagagaggagccttagccctggattccaaggcctatccacttggtgatcagcactgagcaccgaggattcaccatggaactggggctccgctggattctccttgtcgcttgttttagagggtgtccagtgtgaggtgcaacgtggtggaggtcgggggaaccctgggtcgaagggccggggggtcctgagactctctgtgacgcctcgtaggacttcaccttcacgctacctttgacctagtgaacgtcggggtccgccgtacgggcctacccggaagggggaacggggtcgtgggaggtcgggtctcgtatcgtatttaacgttacgaggtggtagattccgtcgtactaacgtacgacaaaagtcaggtacggaacgggcctagttccaaccgtntccgtaccagaacgaccaacgaccaaacgaactcgtaacttaattacctaaacaaatacgaaaccgtcttaaggacgtaacggtaacggaacggaaccgacgtaggttaacgttttagtacgttggtaggtacgaaggaacgacccgaccccgtaaccgtccgttaccttacggtttaccggtacccggttaccggggtaaccttttaacgtttaactttaacccggttacggttacggttacgggtccggttaaccggggg

SEQ ID NO: 150077 - DNA, 377 bp, Homo sapiens
  misc_feature: GYAE6OF01EJ9Z1.34.60.F05.1.454.CMB.1.raw
  modified_base (308)..(308): a, c, t, g, unknown or other
  misc_feature (308)..(308): n is a, c, g, or t
  modified_base (370)..(377): a, c, t, g, unknown or other
  misc_feature (370)..(377): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaacggcccatcggtcttcccctggcaccctcctccaagagcacctctggggcacagcgccngggctgcctggtcaaggactacttccatcacgtgtactgagcgggctggcaaggcgcatagnnnnnnnn

SEQ ID NO: 150078 - DNA, 567 bp, Homo sapiens
  misc_feature: GYAE6OF01EO5FX.34.60.F05.1.454.CMB.1.raw
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
  modified_base (478)..(479): a, c, t, g, unknown or other
  misc_feature (478)..(479): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(503): a, c, t, g, unknown or other
  misc_feature (502)..(503): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(514): a, c, t, g, unknown or other
  misc_feature (511)..(514): n is a, c, g, or t
  modified_base (516)..(522): a, c, t, g, unknown or other
  misc_feature (516)..(522): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
tcagtacacgtgatcacgaccggtgctcgattttagtacgtcatcagggtaaagggtccgggacttcaccactcgtccacgagacaacgtccaagaactcactatttctacaaatgaaacgcctgagagtcgaggaccacaggtgtttatactgtggcgagagcgtcccctaccgtctctattttgtaccgtcggggtacttattattacgtacgggtctgggacgttcgtggggcgaacgggggaccgtcggtcgtccgtcgtcttcgacgtcctccaccaagggtccccattcggtccttcccccgtggcctaccccgtccttccctaagacggtacctacccgttcgtacgggggtcacgacgtccggcccgtacgggcctacgccgtgggtcgacggcttacgtccgtctcgacgttgtacctgacgtcgggctgggactaaggcgtactaagtagcgtgcgtgngngngnncnntcncgnaganagnanatantntnnanananannnnannnnnnntctnntntntgtctntcgtcgcgngcgtcgcgacgcgtcgcgtcg

SEQ ID NO: 150079 - DNA, 499 bp, Homo sapiens
  misc_feature: GYAE6OF01ENH6U.34.60.F05.1.454.CMB.1.raw
  modified_base (465)..(466): a, c, t, g, unknown or other
  misc_feature (465)..(466): n is a, c, g, or t
  modified_base (468)..(499): a, c, t, g, unknown or other
  misc_feature (468)..(499): n is a, c, g, or t
tcagtacacgtgatcacgaccggtgctcgattttagtacgtcatcagggaaagggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcgggacttattattactacggtctggacgtctggggcaaggggaccgcggtcgccgtctcttcagccctccaccaagggcccatcggtccttcccccgtggccacccctccctccaacgacgcacctcgtcggggacacgaggccggacccgtgggctgcctgtcaaggactacttccatccacgttgtacctggacgcgggactggcgaaggccacgattagnngnnnnnnnnnnnnnnnnnnnnnnnnnnnnnnnn

SEQ ID NO: 150080 - DNA, 228 bp, Homo sapiens
  misc_feature: GYAE6OF01D7GHM.34.60.F05.1.454.CMB.1.raw
  modified_base (206)..(206): a, c, t, g, unknown or other
  misc_feature (206)..(206): n is a, c, g, or t
  modified_base (210)..(228): a, c, t, g, unknown or other
  misc_feature (210)..(228): n is a, c, g, or t
tcagtacacgtgatcacgaccggtgctcgatttagtacgtcatcagggaaaggggaccgcggtcgccgtctcttcagcctccaccaagggcccatcggtcttcccctggccaccctcctccaagacgcacctcgtggggcacagcggccctgggctgcctggtcaaggactacttccatcacgtgtactgagcgggctggcagcgnatgnnnnnnnnnnnnnnnnnnn

SEQ ID NO: 150081 - DNA, 490 bp, Homo sapiens
  misc_feature: GYAE6OF01BN5B2.34.60.F05.1.454.CMB.1.raw
  modified_base (344)..(344): a, c, t, g, unknown or other
  misc_feature (344)..(344): n is a, c, g, or t
  modified_base (461)..(490): a, c, t, g, unknown or other
  misc_feature (461)..(490): n is a, c, g, or t
tcagtacacgtgatcacgaccggtgctcgattttagtacgtcatcagggaaagggggctggagtgggtctcatcgagttacttacagtggtgatctcgtctactacgcaaagtcagtgaagggccgattcaccatctccagagacaacgccaaggaactcactatttctacaaactgaaacgcctgagagtcgaggacacaggtgtttattactgtgcgagagagccccaccgctcatttgcctcgggacttatattactacggtctggacgtctggggcaaggggaaccgcggtcgccgtctcttcagcctccaccaagggcccatcggtccttcccctggcnccctcctccaagacgtcaccctcgtgggggcacgacgcggccctgggcctgcccttggtcaacggactaccgttccactcacgtgtactcgagcgggctggcaaggcgactatacgnnnnnnnnnnnnnnnnnnnnnnnnnnnnnn

SEQ ID NO: 150082 - DNA, 214 bp, Homo sapiens
  misc_feature: GYAE6OF01ETAEE.34.60.F05.1.454.CMB.1.raw
  modified_base (211)..(214): a, c, t, g, unknown or other
  misc_feature (211)..(214): n is a, c, g, or t
tcagtacacgtgatcacgaccggtgctcgatttagtacgtcatcagggaaaggggaccgcggtcgccgtctcttcagcctccaccaagggcccatcggtcttcccctggcaccctcctccaagagcacctctgggggcacagcggccctgggctgcctggtcaaggactacttccatcacgtgtactgagcgggctggcaaggcgcatagnnnn

SEQ ID NO: 150083 - DNA, 225 bp, Homo sapiens
  misc_feature: GYAE6OF01DQUQX.34.60.F05.1.454.CMB.1.raw
  modified_base (212)..(225): a, c, t, g, unknown or other
  misc_feature (212)..(225): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnnnnnnnnnnn

SEQ ID NO: 150084 - DNA, 454 bp, Homo sapiens
  misc_feature: GYAE6OF01B7H84.34.60.F05.1.454.CMB.1.raw
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (444)..(454): a, c, t, g, unknown or other
  misc_feature (444)..(454): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttccccctggccaccctcctccaagagccacctctggggcacaggccggcccgtgggctgcctggtcaaggactacgttccatcacgtgtactgngcgggctggcaaggcnatagnnnnnnnnnnn

SEQ ID NO: 150085 - DNA, 214 bp, Homo sapiens
  misc_feature: GYAE6OF01CQQLM.34.60.F05.1.454.CMB.1.raw
  modified_base (212)..(214): a, c, t, g, unknown or other
  misc_feature (212)..(214): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnn

SEQ ID NO: 150086 - DNA, 486 bp, Homo sapiens
  misc_feature: GYAE6OF01C8NOF.34.60.F05.1.454.CMB.1.raw
  modified_base (263)..(263): a, c, t, g, unknown or other
  misc_feature (263)..(263): n is a, c, g, or t
  modified_base (475)..(486): a, c, t, g, unknown or other
  misc_feature (475)..(486): n is a, c, g, or t
tcagtacacgtgatcacgaccggtgctcgatttagtacgtcatcagggaaaggggctggagtgggtctcatcgattacttacagtggtgatctcgtctactacgcaaattcagtgaagggccgattcaccatctccagagacaacgccaagaactcactatttctacaaatgaaacgcctgagagtcgaggacacaggtgtttattactgtgcgagagagcccccaccgctcatttgcctcgggacttattattactacggtntggacgtcgtggggcaaggggaccgcggtcgccgtctcttcagcctccaccaagggcccatccggtccttccccctggccacccctcctaccaagacgccacctcgtgggggccacgaggccggtcccgtgggcctcggaccctgggtaccaacggaccttaccttccgatctaccgtgtacctggacggcgggctggacgaggcgcatagnnnnnnnnnnnn

SEQ ID NO: 150087 - DNA, 222 bp, Homo sapiens
  misc_feature: GYAE6OF01A06Y2.34.60.F05.1.454.CMB.1.raw
  modified_base (212)..(222): a, c, t, g, unknown or other
  misc_feature (212)..(222): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnnnnnnnn

SEQ ID NO: 150088 - DNA, 395 bp, Homo sapiens
  misc_feature: GYAE6OF01BF84V.34.60.F05.1.454.CMB.1.raw
  modified_base (377)..(395): a, c, t, g, unknown or other
  misc_feature (377)..(395): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagcccaccgctcatttgcctcgggacttattattactacgtctggacgtctggggcaaggggaccgcggtcgccgtctcttcagcctccaccaagggcccatcggtcttcccctggccacctcctccaagacgcacctcgtggggcacagcggccgtgggctgcctggcaaggcctactccatcacgtgtactggaggcgggctggacgaaggcgacgatagcgnnnnnnnnnnnnnnnnnnn

SEQ ID NO: 150089 - DNA, 218 bp, Homo sapiens
  misc_feature: GYAE6OF01BQN01.34.60.F05.1.454.CMB.1.raw
  modified_base (211)..(218): a, c, t, g, unknown or other
  misc_feature (211)..(218): n is a, c, g, or t
tcagtacacgtgatcacgaccggtgctcgatttagtacgtcatcagggaaaggggaccgcggtcgccgtctcttcagcctccaccaagggcccatcggtcttcccctggcaccctcctccaagagcacctctgggggcacagcggccctgggctgcctggtcaaggactacttccatcacgtgtactgagcgggctggcaaggcgcatagnnnnnnnn

SEQ ID NO: 150090 - DNA, 750 bp, Homo sapiens
  misc_feature: GYAE6OF01B9ZW6.34.60.F05.1.454.CMB.1.raw
  modified_base (174)..(174): a, c, t, g, unknown or other
  misc_feature (174)..(174): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagtacacgtgatcacgaccggtgctcgatttagtacgtcatcagggaaagggggagagaggagccttagccctggattccaaggcctatccacttggtgatcagcactgagcaccgaggattcacatggaactgggctcgctggattctccttgtcgcttgttttagaggtntccagtgtgaggtgcaacgtggtggaggtcgggggaaccctggtacgaacgggccgggggtccngacgtacctctctgngactcctcgtcgntctacctacacgctaccgttagactagtacgaccgtcggtccgccgtaggtacccacgggaagggggacgggtccggttgggtacgttcggggtcctacgtacgttaccgttaactttaccgttaacgtgggttaggtacgtaccgttccgttaccgtaccgttaaaccgtaccgtaacgtaaggttaccgtaggtaacggacgggtacctaccttacgacctagtccgaacgagaaccaaccgaccgactaaacgtacctacttaactttactacgtaactaacgtacgaaccgtacgtaggtacgtaacgtcgaacggtactaggttaggtttacttacgttcgtaggacgcggtaacggccggacccgtcccccgagttacccgttcgttacgtaccgggttcccgggttaccggttacttttacggtttaaccttaccgggtttaccggtaccgggtttacggcgggttaacccgggggg

SEQ ID NO: 150091 - DNA, 225 bp, Homo sapiens
  misc_feature: GYAE6OF01BCHVU.34.60.F05.1.454.CMB.1.raw
  modified_base (214)..(225): a, c, t, g, unknown or other
  misc_feature (214)..(225): n is a, c, g, or t
tcagtacacgtgatcacgaccggtgctcgatttagtacgtcatcagggaaaggggaccgcggtcgccgtctcttcagcctccaccaagggcccatcggtcttccccctggccaccctcctccaagagcacctcgtgggggcacagcggccctgggctgcctggtcaaggactacttccatcacgtgtactgagcgggctggcaaggcgcatagnnnnnnnnnnnn

SEQ ID NO: 150092 - DNA, 218 bp, Homo sapiens
  misc_feature: GYAE6OF01BHLDS.34.60.F05.1.454.CMB.1.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (207)..(218): a, c, t, g, unknown or other
  misc_feature (207)..(218): n is a, c, g, or t
tcagtacacgtgatcacgaccggtgctcgatttagtacgtcatcagggaaaggggaccgcggtcgccgtctcttcagcctccaccaaggcccatcggtcttcccctgcaccctcctccaagagcacctcgtgggggcacagcggccctgggctgcctggtcaagactacttcatcacgtntactgagcgggntggacaggcacatgnnnnnnnnnnnn

SEQ ID NO: 150093 - DNA, 245 bp, Homo sapiens
  misc_feature: GYAE6OF01EFZ5P.34.60.F05.1.454.CMB.1.raw
  modified_base (232)..(245): a, c, t, g, unknown or other
  misc_feature (232)..(245): n is a, c, g, or t
tcagtacacgtgatcacgaccggtgctcgatttagtacgtcatcagggaaaggggaccgcggtcgccgtctcttcagcctccaccaagggcccatccggtccttccccctggccaccctccctccaagagccaccttcgtgggggcacacggcggccccgtggggctcgccgtggtcaaggtaccttacttccatcgacgtgtactgacgcgggctggacaaggcgcatagnnnnnnnnnnnnnn

SEQ ID NO: 150094 - DNA, 214 bp, Homo sapiens
  misc_feature: GYAE6OF02I8CP5.34.60.F05.1.454.CMB.1.raw
  modified_base (211)..(214): a, c, t, g, unknown or other
  misc_feature (211)..(214): n is a, c, g, or t
tcagtacacgtgatcacgaccggtgctcgatttagtacgtcatcagggaaagggaccgcggtcgccgtctcttcagcctccaccaagggcccatcggtcttcccctggcaccctcctccaagagcacctctggggcacagcggccgtggctgccgtggtacaaggactactccatcacgtgtactgaggcgggctggacaaggcgcatagnnnn

SEQ ID NO: 150095 - DNA, 212 bp, Homo sapiens; identical to SEQ ID NO: 150062
  misc_feature: GYAE6OF02IOHKG.34.60.F05.1.454.CMB.1.raw
  modified_base (209)..(212): a, c, t, g, unknown or other
  misc_feature (209)..(212): n is a, c, g, or t

SEQ ID NO: 150096 - DNA, 211 bp, Homo sapiens
  misc_feature: GYAE6OF02GJ4DB.34.60.F05.1.454.CMB.1.raw
  modified_base (209)..(211): a, c, t, g, unknown or other
  misc_feature (209)..(211): n is a, c, g, or t
tcagtacacgtgatcacgaccggtgctcgatttagtacgtcatcagggaaagggaccgcggtcgccgtctcttcagcctccaccaagggcccatcggtcttcccctggcaccctcctccaagagcacctctggggcacagcggccctgggctgcctggtcaaggactacttccatcacgtgtactgagcgggctggcaaggcgcatagnnn

SEQ ID NO: 150097 - DNA, 380 bp, Homo sapiens
  misc_feature: GYAE6OF02H49YL.34.60.F05.1.454.CMB.1.raw
  modified_base (374)..(380): a, c, t, g, unknown or other
  misc_feature (374)..(380): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggacgccgtctcttcagcctccaccaagggccccatcggtcttccccctggcaccctcctccaagagcacctctgggggcacagcggccctgggctgcctggtcaaggctacttccatcacgtgtactgagcgggctggcaaggcgcatagnnnnnnn

SEQ ID NO: 150098 - DNA, 213 bp, Homo sapiens
  misc_feature: GYAE6OF02GC5MZ.34.60.F05.1.454.CMB.1.raw
  modified_base (210)..(213): a, c, t, g, unknown or other
  misc_feature (210)..(213): n is a, c, g, or t
tcagtacacgtgatcacgaccggtgctcgatttagtacgtcatcagggaaaggggaccgcggtcgccgtctcttcagcctccaccaagggcccatcggtcttcccctggcaccctcctccaagagcacctctggggcacagcggccctgggctgcctggtcaaggactacttccatcacgtgtactgagcgggctggcaaggcgcatagnnnn

SEQ ID NO: 150099 - DNA, 454 bp, Homo sapiens
  misc_feature: GYAE6OF02JNX35.34.60.F05.1.454.CMB.1.raw
  modified_base (419)..(419): a, c, t, g, unknown or other
  misc_feature (419)..(419): n is a, c, g, or t
  modified_base (441)..(454): a, c, t, g, unknown or other
  misc_feature (441)..(454): n is a, c, g, or t
tcagtacacgtgatcacgaccggtgctcgatttagtacgtcatcagggaaaggggcgtggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctgacgtctggggcaaggggacgcggtcgccgtctctcagcctccacaaggcccatcggtctcccctggcaccctcctcaagagcacctctggggcacagtccggccctgggctcgacctggtcaaggcctacttccatcacgtgactgagcgggntcgggacaaggcgtcacgtagnnnnnnnnnnnnnn

SEQ ID NO: 150100 - DNA, 213 bp, Homo sapiens; identical to SEQ ID NO: 150098
  misc_feature: GYAE6OF02FS8VY.34.60.F05.1.454.CMB.1.raw
  modified_base (210)..(213): a, c, t, g, unknown or other
  misc_feature (210)..(213): n is a, c, g, or t

SEQ ID NO: 150101 - DNA, 448 bp, Homo sapiens
  misc_feature: GYAE6OF02HSF9G.34.60.F05.1.454.CMB.1.raw
  modified_base (439)..(448): a, c, t, g, unknown or other
  misc_feature (439)..(448): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgcccgtctcttcagcctccaccaagggcccatcggtcttccccctggcacccctcctccaagagcacctctggggcacagcggccctgggctgcctggtcaaggctactccatcacgtgtactgagcgggctggcaaggcgcatagnnnnnnnnnn

SEQ ID NO: 150102 - DNA, 450 bp, Homo sapiens
  misc_feature: GYAE6OF02JZJCH.34.60.F05.1.454.CMB.1.raw
  modified_base (439)..(450): a, c, t, g, unknown or other
  misc_feature (439)..(450): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaaggcccatcggtcttccccctggccaccctcctccaagacgcacctctggggcacagcggccctgggctgcctggtcaaggactacttccatcacgtgtactgagcgggctggcaggcgcatagnnnnnnnnnnnn

SEQ ID NO: 150103 - DNA, 212 bp, Homo sapiens
  misc_feature: GYAE6OF02HEEYD.34.60.F05.1.454.CMB.1.raw
  modified_base (211)..(212): a, c, t, g, unknown or other
  misc_feature (211)..(212): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctggggcacagcggccctgggctgcctggtcaaggactacttccatcacgtgtactgagcgggctggcaaggcgcatagnn

SEQ ID NO: 150104 - DNA, 442 bp, Homo sapiens
  misc_feature: GYAE6OF02IBOCE.34.60.F05.1.454.CMB.1.raw
  modified_base (324)..(324): a, c, t, g, unknown or other
  misc_feature (324)..(324): n is a, c, g, or t
  modified_base (437)..(442): a, c, t, g, unknown or other
  misc_feature (437)..(442): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccggtctcttcagcctccaccaagggcccancggtcttccccctggcaccctctccaagagcacctctggggcacagcggccctgggctgcctggtcaaggctattccatcacgtgtactgagcgggctggcaaggcgcatagnnnnnn

SEQ ID NO: 150105 - DNA, 381 bp, Homo sapiens
  misc_feature: GYAE6OF02I01FY.34.60.F05.1.454.CMB.1.raw
  modified_base (373)..(381): a, c, t, g, unknown or other
  misc_feature (373)..(381): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttcccctggcaccctcctccaagagcacctctgggggcacagcggccctgggctgcctggtcaaggactacttccatcacgtgtactgagcgggctggcaaggcgcatagnnnnnnnnn

SEQ ID NO: 150106 - DNA, 429 bp, Homo sapiens
  misc_feature: GYAE6OF02FKG5Z.34.60.F05.1.454.CMB.1.raw
  modified_base (395)..(429): a, c, t, g, unknown or other
  misc_feature (395)..(429): n is a, c, g, or t
tcagtacacgtgatcacgaccggtgctcgatttagtacgtcatcagggaaagggccgattacgacccaatctcccagaggacaacgcccaagaactcactattctacaaatgaaacgcctggagagtcgaggacactaggtggtttattactgtgcgagagagccccaccgctccatttgcctcggggacttattattactacgggtctggacgtctggggcaaggggaccgcggtcgccggtctcttcagcctccaccaagggcccatcggtcttcccccctggcaccctcctcctaacgagcacctctgggggcacagcggccctgggctggcctggtcaaggactacgtccagtcacgtgtactggagacgggctgggcaagggcgcatagnnnnnnnnnnnnnnnnnnnnnnnnnnnnnnnnnnn

SEQ ID NO: 150107 - DNA, 445 bp, Homo sapiens
  misc_feature: GYAE6OF02GSW9C.34.60.F05.1.454.CMB.1.raw
  modified_base (438)..(445): a, c, t, g, unknown or other
  misc_feature (438)..(445): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttccccctggcaccctcctccaagagcacctctggggcacagcggccctgggctgcctggtcaggactacttccatcacgtgtactgagcgggctggcaaggcgcatagnnnnnnnn

SEQ ID NO: 150108 - DNA, 442 bp, Homo sapiens
  misc_feature: GYAE6OF02IQAIT.34.60.F05.1.454.CMB.1.raw
  modified_base (437)..(442): a, c, t, g, unknown or other
  misc_feature (437)..(442): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggccatcggtcttcccctggcaccctcctccagagcacctctggggcacgagtcggccctgggctgcctggtcaaggactactccatcacgtgtactgagcgggctggcaaggcgcatagnnnnnn

SEQ ID NO: 150109 - DNA, 214 bp, Homo sapiens; identical to SEQ ID NO: 150082
  misc_feature: GYAE6OF02I16QD.34.60.F05.1.454.CMB.1.raw
  modified_base (211)..(214): a, c, t, g, unknown or other
  misc_feature (211)..(214): n is a, c, g, or t

SEQ ID NO: 150110 - DNA, 377 bp, Homo sapiens
  misc_feature: GYAE6OF02GKA5R.34.60.F05.1.454.CMB.1.raw
  modified_base (372)..(377): a, c, t, g, unknown or other
  misc_feature (372)..(377): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctgggcaaggggaccgcggtcgccgtctcttcagcctccaccaagggcccatcggtcttcccctggcaccctcctccaagagcacctctgggggcacagcggccctgggctgcctggtcaaggactacttccatcacgtgtactgagcgggctggcaaggcgcatagnnnnnn

SEQ ID NO: 150111 - DNA, 216 bp, Homo sapiens
  misc_feature: GYAE6OF02ILETD.34.60.F05.1.454.CMB.1.raw
  modified_base (212)..(216): a, c, t, g, unknown or other
  misc_feature (212)..(216): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnn

SEQ ID NO: 150112 - DNA, 558 bp, Homo sapiens
  misc_feature: GYAE6OF02F9WR3.34.60.F05.1.454.CMB.1.raw
  modified_base (466)..(466): a, c, t, g, unknown or other
  misc_feature (466)..(466): n is a, c, g, or t
tcagtacacgtgatcacgaccggtgctcgatttagtacgtcatcagggaaagggggagagaggagccttagccctggattccaaggcctatccacttggtgatcagcactgagcaccgaggattcaccatggaactggggctccgctggattctccttgtcgctgttttagagggtgtccagtgtgaggtgcaactggtggagtcgggggaaccctggtcaaggccggggggtccctgagactctcctgtgaagcctctggattcaccttcagcactttgacatgaactgggtccgccaggctccgaggggaacggggctgggagtgggtctcatcgattacttacagtggtgatctcgtctactacgcaaagtcagtgaaggccgattcacatctcagagacacgccaagactcacttattacaactaaatagaaaccgctagacgagtacggagacacaggttntttaacttacgtgtgacgagagacgccccacgctcactttcgcccgttcgggtaactttacgttacttaacgttcggtctaggacgttcggg

SEQ ID NO: 150113 - DNA, 471 bp, Homo sapiens
  misc_feature: GYAE6OF02IIFO8.34.60.F05.1.454.CMB.1.raw
  modified_base (360)..(360): a, c, t, g, unknown or other
  misc_feature (360)..(360): n is a, c, g, or t
  modified_base (458)..(471): a, c, t, g, unknown or other
  misc_feature (458)..(471): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaagggggaccgcggtcgccgtctcttcagcctccaccaaggggcccatccggtcttcccccctggccacccctcctccaacgngccacctcgtcggggcacgacgccggccctgggctgcctggtcaaggactactccatcacgtgtacgtgacgcgggcgtggccaagggcgacatacgnnnnnnnnnnnnnn

SEQ ID NO: 150114 - DNA, 463 bp, Homo sapiens
  misc_feature: GYAE6OF02IKG1R.34.60.F05.1.454.CMB.1.raw
  modified_base (453)..(463): a, c, t, g, unknown or other
  misc_feature (453)..(463): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgccctcggggacttattattactacggtctggacgtctggggcaaggggaccgcggtcgccgtctcttcagcctccaccaagggcccagtccggtctccccctggccaccctcctccaagacgcacctcgtcggggcacgagccggcctgggctcgcctggtcaaggactacgtccatcacgtgtactgacgcgggctcgggcaagggcgacagtagnnnnnnnnnnn

SEQ ID NO: 150115 - DNA, 110 bp, Homo sapiens
  misc_feature: GYAE6OF02HBRKC.34.60.F05.1.454.CMB.1.raw
  modified_base (109)..(110): a, c, t, g, unknown or other
  misc_feature (109)..(110): n is a, c, g, or t
tcagtacacgtgatcacgaccggtgctcgatttagtacgtcatcagggaaaggggaccgcggtcgccgtctcttcagcctccaccaagggcccatcggtcttccccctnn

SEQ ID NO: 150116 - DNA, 402 bp, Homo sapiens
  misc_feature: GYAE6OF02H3GZH.34.60.F05.1.454.CMB.1.raw
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (381)..(381): a, c, t, g, unknown or other
  misc_feature (381)..(381): n is a, c, g, or t
  modified_base (387)..(388): a, c, t, g, unknown or other
  misc_feature (387)..(388): n is a, c, g, or t
  modified_base (390)..(402): a, c, t, g, unknown or other
  misc_feature (390)..(402): n is a, c, g, or t
tcagtacacgtgatcacgaccggtgctcgatttagtacgtcatcagggaaagggccgattcaccatctccagagacaacgccaagaactcactatttctacaaatgaaacgcctgagagtcgaggacacaggtgtttattactgtgcgagagagccccaccgctcatttgccgtcggggacttattattactacggtctggacgtcgtggggcgaaggggaccggcggtccgccgtctcttcacgccctccaccaagggcccatccggtccttccccnggccacccctcctccaagagccacctcgtgggggcacgagccggccctggcngcctggtcaaggctactcactcacgtgtactgacgcggctggacaacggcnaatagnncnnnnnnnnnnnnn

SEQ ID NO: 150117 - DNA, 476 bp, Homo sapiens
  misc_feature: GYAE6OF02JD8ZK.34.60.F05.1.454.CMB.1.raw
  modified_base (443)..(443): a, c, t, g, unknown or other
  misc_feature (443)..(443): n is a, c, g, or t
  modified_base (448)..(476): a, c, t, g, unknown or other
  misc_feature (448)..(476): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccattcaccatctccagagacaacgccaagaactcactatttctacaaatgaaacgcctgagagtcgaggacacaggtgttattactgtgcgagagagccccacgctcatttgcctcgggacttatattactacggtctgacgtctggggcaaggggaccgcggtcgcccgtctcttcagcctccaccaagggcccatcggtcttccccctggcaccctcctccaagcgcacctctggggcacagccggccctggggcctgcctggtcaacgggactaccgtccatccacgtgtaactcgagtcgggactggcgaaggcgcanaggannnnnnnnnnnnnnnnnnnnnnnnnnnnn

SEQ ID NO: 150118 - DNA, 550 bp, Homo sapiens
  misc_feature: GYAE6OF02HWXTY.34.60.F05.1.454.CMB.1.raw
  modified_base (299)..(299): a, c, t, g, unknown or other
  misc_feature (299)..(299): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (540)..(540): a, c, t, g, unknown or other
  misc_feature (540)..(540): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaaggccgattcaccatctccagagacaacgccaagaactcaccatttctacaaatgaaacgcctgagagtcgaggacacaggtgtttattactgtgcgagagagccccaccgctcattgcctcgggacttatattactacggtctggacgtcgtgggcaaggggccgcggtcgccgtctcttcncgcctccaccagggcccagtccggtacttcccccgtaggccaccctcctccaacgcgccacctcgtcgggcgacagccggccgtcgggctcgccgtcgtcgaaacggacctactccatcctaccgtgttacgtggaggccggtcgtgggccaacgggcgaccgtagttacgagtgacgtgtanctagcaccgtgacgcagtcgngaacgttncgntgcgtacngcgtcgtgacgtgctacngcgtcgctcg

SEQ ID NO: 150119 - DNA, 734 bp, Homo sapiens
  misc_feature: GYAE6OF02FGSZ0.34.60.F05.1.454.CMB.1.raw
  modified_base (354)..(354): a, c, t, g, unknown or other
  misc_feature (354)..(354): n is a, c, g, or t
tcagtacacgtgatcacgaccggtgctcgatttagtacgtcatcagggaaagggggagagaggagccttagccctggattccaaggcctatccacttggtgatcagcactgagcaccgaggattcaccatggaactggggctccgctggattctccttgtcgctgttttagaggtgtccagtgtgaggtgcaactggtggaggtcgggggacctggtcgaacggccgggggtcctgagactcgtcctgtgaacgtcctcgtcggattcacctttcacgcctaccttttcggactagttgaacttggggtcccgaccgaggcctccgagggggaacgggctggagtgggtctcgntcgattacttacaggtacggtgattctcgttctactacgacgtaaatcgaaggttgggaaacggggtccctagttcccaaccgtaactccgtaaccgaagacgaaccgaaccgtaccgaaacgtaaacctaccaacctttaacgtttccaaactaaagtaacgaaacccgtcccgttacgaggtaacgttccggaaagggaaccaacgtagggtttagtttttaaacttaccgttaggtagtaccgaaggtacggaacccgtacccccgaccggtaccttacgacggttttaccgtaccccggttacggggttaaaccttttacgtttaacgtttaaccgggttaccggttaccggttcgggttaaccggttaccggggg

SEQ ID NO: 150120 - DNA, 235 bp, Homo sapiens
  misc_feature: GYAE6OF02FJQ4Q.34.60.F05.1.454.CMB.1.raw
  modified_base (213)..(235): a, c, t, g, unknown or other
  misc_feature (213)..(235): n is a, c, g, or t
tcagtacacgtgatcacgaccggtgctcgatttagtacgtcatcagggaaaggggaccgcggtcgccgtctcttcagcctccaccaagggcccatcggtcttccccctggcaccctcctccaagagcacctctggggggcacagcggccctgggctgcctggtcaaggactacttccatcacgtgtactgagcgggctggcaaggcgcatagnnnnnnnnnnnnnnnnnnnnnnn

SEQ ID NO: 150121 - DNA, 622 bp, Homo sapiens
  misc_feature: GYAE6OF02GRAJO.34.60.F05.1.454.CMB.1.raw
  modified_base (385)..(385): a, c, t, g, unknown or other
  misc_feature (385)..(385): n is a, c, g, or t
tcagtacacgtgatcacgaccggtgctcgatttagtacgtcatcagggaaagggggagagaggagccttagccctggattccaaggcctatccacttggtgatcagcactgagcaccgaggattcaccatggaactggggctccgctggattctccttgtcgctgttttagaggtgtccagtgtgaggtgctaactgggtggaggtcgggggaaccctggtcgaacgggtccggggggtccctgagacgtcctcctgtcgaagccctcgtggtattcgaccttcagcctaccttgactagtcgaacgtcgggtccgccgacggcctccgaggggaacgggtcgtgggagtgggtctcgtagtacgtattacgttacgaggtggtntacgtcttcgtctactacgactaaagtcgagtaggaacggaccgtattccaccgtatctaccgagaacgacaacgaccaaagactactacgttacttacactaaatacgaactacgtacgagtacgtacgaacgacacgtagttacgttaagttactagtgacggacagccgacccaccgactctactttcggccgttacgggtacttacgttacttacgtacgtgtacgcgtacgg

SEQ ID NO: 150122 - DNA, 861 bp, Homo sapiens
  misc_feature: GYAE6OF02GB3KK.34.60.F05.1.454.CMB.1.raw
  modified_base (137)..(137): a, c, t, g, unknown or other
  misc_feature (137)..(137): n is a, c, g, or t
  modified_base (536)..(536): a, c, t, g, unknown or other
  misc_feature (536)..(536): n is a, c, g, or t
tcagtacacgtgatcacgaccggtgctcgatttagtacgtcatcagggaaagggggagagaggagccttagccctggattccaaggcctatccacttggtgatcagcactgagcacgagatcacatggaactgggcnccgactcggattcctctgtcgcttgtttaggaggtgtccagttggtgagggtgacgtaacgtgggtaggacggtccgggggaaccctgggtaccgaacggggtcccggggggtcctggacgtacctccgttccgtgtacggacgtcccttcgtaggtactttcccgacctttacgacggtaccttaccgtttagaacgtacgtacggtaaccggttcggcccgtaccgcggtaccgttaccgaaggggtacggggtcgtagggtcggtcggtcctacaaggttccgtaacgttaacgttcggacgggttcggtagttaacctccgttaccgttcgtaaaccgtacccgtaaggaaaccgtttcgaacggtacggggtaaacgacccgttacttaacccnctaccgttacgtacccaagggtaaaccgaaactaccccggaacctaaacggtaccttaaccgaagtttaccctttaacgaaaccgttaaagtaaccggtaacccgtaccgtaagggtaactaccgggtaacgggaaaccgtaaccggacggttttaagggttccttttttaaacggtcgtttaagccgggtaaccggtaacggtaccgggtacccaccccggttaacctcggtacctttaccggttacccggtaccggttaccgtttaacccgttaagtttaacgtttaccggttacggtaccggttccggtacggttacccggg

SEQ ID NO: 150123 - DNA, 546 bp, Homo sapiens
  misc_feature: GYAE6OF02I9QKX.34.60.F05.1.454.CMB.1.raw
  modified_base (235)..(235): a, c, t, g, unknown or other
  misc_feature (235)..(235): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
  modified_base (515)..(546): a, c, t, g, unknown or other
  misc_feature (515)..(546): n is a, c, g, or t
tcagtacacgtgatcacgaccggtgctcgatttagtacgtcatcagggaaagggggctggagtgggtctcatcgattacttacagtggtgatctcgtctactacgcaaagtcagtgaagggccgattcaccatctccagagacaacgccaagaactcactatttctaacaaatgaaacgcctgagagtcgaggacacaggtgtttattactgtgcgagagacgcccccaccgctnatttcgccgtcggggtactttattattactacggtctggacgtcgtgggcgaaggggaccgcggtcgcccgtctcttcgacgcctcccgaccgacgggccccagtccgggttcctttcccccgtggcccaccccttccctaccgaacgcgcctaccgtcgtgggggcccacgacgccgggccccgtggggtcctcggcctgggtaccgacgggtaactccgttccactcgaccgttcgtcgttggacggcgggtcgnggcgaaggccgtacagtgntgcnnnnnnnnnnnnnnnnnnnnnnnnnnnnnnnn

SEQ ID NO: 150124 - DNA, 552 bp, Homo sapiens
  misc_feature: GYAE6OF02IA0KK.34.60.F05.1.454.CMB.1.raw
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(522): a, c, t, g, unknown or other
  misc_feature (519)..(522): n is a, c, g, or t
  modified_base (524)..(524): a, c, t, g, unknown or other
  misc_feature (524)..(524): n is a, c, g, or t
  modified_base (527)..(529): a, c, t, g, unknown or other
  misc_feature (527)..(529): n is a, c, g, or t
  modified_base (534)..(535): a, c, t, g, unknown or other
  misc_feature (534)..(535): n is a, c, g, or t
  modified_base (538)..(539): a, c, t, g, unknown or other
  misc_feature (538)..(539): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(549): a, c, t, g, unknown or other
  misc_feature (545)..(549): n is a, c, g, or t
  modified_base (551)..(552): a, c, t, g, unknown or other
  misc_feature (551)..(552): n is a, c, g, or t
tcagtacacgtgatcacgaccggtgctcgatttagtacgtcatcagggaaaggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcgggacttattattactacgtctgacgtctgggcgaagggaccgcggtcgccgtctcttcagcctcccacacgggcccagtcggttccttccccctggcctacccctcctccaagtacgcacctcgtcggggccacgacgcggcccgtgggctcggccgttcggacgaaacgggaccttaccttacccgtataccgtaccggtacgtaccgttaggaacgggtcgggtacctacggggaacctaacgggcccgtagtaagttcgagntcagcgagnangnnnngnagnnngacgnngcnngncngnnnnncnn

SEQ ID NO: 150125 - DNA, 707 bp, Homo sapiens
  misc_feature: GYAE6OF02I4ICB.34.60.F05.1.454.CMB.1.raw
  modified_base (603)..(603): a, c, t, g, unknown or other
  misc_feature (603)..(603): n is a, c, g, or t
  modified_base (613)..(613): a, c, t, g, unknown or other
  misc_feature (613)..(613): n is a, c, g, or t
  modified_base (620)..(620): a, c, t, g, unknown or other
  misc_feature (620)..(620): n is a, c, g, or t
  modified_base (670)..(670): a, c, t, g, unknown or other
  misc_feature (670)..(670): n is a, c, g, or t
tcagtacacgtgatcacgaccggtgctcgatttagtacgtcatcagggaaagggggctggagtgggtctcatcgattacttacagtggtgatctcgtctactacgcaaagtcagtgaagggccgattcaccatctccagagacaacgccaagaactcactatttctacaaatgaaacgcctgagagtcgaggacacgaggttgtttattactgtgcgagagacgcccaccgctcatttcgccgtcgggtacttattactactcggtctggacgtcgtggggcgaacggggaccgcgggtcgcccgttctcgttcgcgtcccgtaccaaccgacgggccctagtcccggttcccttccccgtggacctacccctccgtacccgaaggtcgacctaccgtcggtacggggactaacgacggcccggtacccgtcgggccgtacggtcccggttacggtaccgtaacgggtacccttacccgtttaccgacgtttacccgtaacggtttaccgtaacggttcgggaccgggtacgggtccggtacgggaaccgggtaacgggtcccgtaacggtaacgtttacgggactacggactgccgggtaancggttaacgntaacggntacgaacgttcgcgttaccgacttcgggctcggctaacggtctcggtaanccggaatttcccaggaccttaggcttaacggactcgg

SEQ ID NO: 150126 - DNA, 201 bp, Homo sapiens
  misc_feature: GYAE6OF01AE0JT.44.86.H09.1.454.CMB.1.raw
  modified_base (173)..(201): a, c, t, g, unknown or other
  misc_feature (173)..(201): n is a, c, g, or t
tcagacagtatatacacgaccggtgctcgatttagtgctatagacttgggtttgggttttcggcggagggacccgactgaccgtcctaagtcagcccaaggctgccccctcggtcactctgttcccgccctcctctatatactgtctgagtcgggctggcaaggcgtcatagnnnnnnnnnnnnnnnnnnnnnnnnnnnnn

SEQ ID NO: 150127 - DNA, 191 bp, Homo sapiens
  misc_feature: GYAE6OF01CBO85.44.86.H09.1.454.CMB.1.raw
  modified_base (190)..(191): a, c, t, g, unknown or other
  misc_feature (190)..(191): n is a, c, g, or t
tcagacagtatatacacgaccggtgctcgatttagtgctatagacttgggtttgggactccagccttggtggtggggttttcggcggagggacccgactgaccgtcctaagtcagcccaaggctgcccctcggtcactctgttcccaccctctctatatactgtctgagcgggctggcaaggcgcatagnn

SEQ ID NO: 150128 - DNA, 262 bp, Homo sapiens
  misc_feature: GYAE6OF01BLC0P.44.86.H09.1.454.CMB.1.raw
  modified_base (257)..(262): a, c, t, g, unknown or other
  misc_feature (257)..(262): n is a, c, g, or t
tcagacagtatatacacgaccggtgctcgatttagtgctatagacttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 150129 - DNA, 194 bp, Homo sapiens
  misc_feature: GYAE6OF01BS4H2.44.86.H09.1.454.CMB.1.raw
  modified_base (192)..(194): a, c, t, g, unknown or other
  misc_feature (192)..(194): n is a, c, g, or t
tcagacagtatatacacgaccggtgctcgatttagtgctatagacttgggtttgggactccagccttggtggtggggttttcggcggagggacccgactgaccgtcctaagtcagcccaaggctgccccctcggtcactctgttcccgccctcctctatatactgtctgagcgggctggcaaggcgcatagnnn

SEQ ID NO: 150130 - DNA, 173 bp, Homo sapiens
  misc_feature: GYAE6OF01BVN6Z.44.86.H09.1.454.CMB.1.raw
  modified_base (172)..(173): a, c, t, g, unknown or other
  misc_feature (172)..(173): n is a, c, g, or t
tcagacagtatatacacgaccggtgctcgatttagtgctatagacttgggtttggggttttcggcggagggacccgactgaccgtcctaagtcagcccaaggctgccccctcggtcactctgttcccgccctcctctatatactgtctgagcgggctggcaaggcgcatagnn

SEQ ID NO: 150131 - DNA, 183 bp, Homo sapiens
  misc_feature: GYAE6OF01C7QTZ.44.86.H09.1.454.CMB.1.raw
  modified_base (174)..(183): a, c, t, g, unknown or other
  misc_feature (174)..(183): n is a, c, g, or t
tcagacagtatatacacgaccggtgctcgatttagtgctatagacttggggtttggggttttcggcggagggacccgactgaccgtcctaagtcagcccaaggctgccccctcggtcactctgttccccgcctcctctatatactgtctggagcgggctggcaaggcgcatagnnnnnnnnnn

SEQ ID NO: 150132 - DNA, 532 bp, Homo sapiens
  misc_feature: GYAE6OF01A28B6.44.86.H09.1.454.CMB.1.raw
  modified_base (339)..(339): a, c, t, g, unknown or other
  misc_feature (339)..(339): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (517)..(517): a, c, t, g, unknown or other
  misc_feature (517)..(517): n is a, c, g, or t
tcagacagtatatacacgaccggtgctcgatttagtgctatagacttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatccccggacaaacccccccaaatcttgattcatgaaatctactaagcggccctgtgggtatttcngatcgcttctctgctccgaggtccgcaacacggcctccctgacatctcgtggctccagcctgaggacgagctaaatntttctgttcctnatatcagttcttgttggttggtcttcgggcggtagggccgtaggtcgaccgtcgtaggtcacggcccaaggctccgccccgtcggtccnctcgtccgtcccccg

SEQ ID NO: 150133 - DNA, 188 bp, Homo sapiens
  misc_feature: GYAE6OF01CEKOD.44.86.H09.1.454.CMB.1.raw
  modified_base (171)..(188): a, c, t, g, unknown or other
  misc_feature (171)..(188): n is a, c, g, or t
tcagacagtatatacacgaccggtgctcgatttagtgctatagacttgggtttggggttttcggcggagggacccgactgaccgtcctaagtcagcccaaggctgcccctcggtcactctgttcccaccctcctctatatactgtctgagcgggctggcaaggcgcatagnnnnnnnnnnnnnnnnnn

SEQ ID NO: 150134 - DNA, 239 bp, Homo sapiens
  misc_feature: GYAE6OF01CJ3WR.44.86.H09.1.454.CMB.1.raw
  modified_base (191)..(239): a, c, t, g, unknown or other
  misc_feature (191)..(239): n is a, c, g, or t
tcagacagtatatacacgaccggtgctcgatttagtgctatagacttgggtttgggactccagccttggtggtggggttttcggcggagggacccgactgaccgtcctaagtcagcccaagctgccccctcggtcactctgttcccgccctcctctatatactgtctgagcgggctggcaaggcgcatagnnnnnnnnnnnnnnnnnnnnnnnnnnnnnnnnnnnnnnnnnnnnnnnnn

SEQ ID NO: 150135 - DNA, 675 bp, Homo sapiens
  misc_feature: GYAE6OF01BK42V.44.86.H09.1.454.CMB.1.raw
  modified_base (322)..(322): a, c, t, g, unknown or other
  misc_feature (322)..(322): n is a, c, g, or t
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttctcattcactgcgcagggtcctgggcccagtctgcattgacgcacgccgccctcagtgtctgccggccccaggacagagcgtcgccatctcctgctctggaacactccaacattggtacgtaatcatgttacatcgtaaccaaaagtcgacgtggctccgaccctaagtcctctattangagtatcttacgaccgcccacgtggactcgtctgaccgtattcctctcgtcctacgtaagttcgtacggtaacttccgacgtcctacgtttcggacctacgtacccgtacccggtacctccgaacggaccgttacgggacgtaaccggacgggtacccgtaagtttaccttaggtttcgggttcgggtccgtttacgggtacccttaccgtacggtccggttttggggttcggggtttccgggggttttccgggcggggtaaccggggtaccccgtacgggttcccgtacccggttaccgttaacggtcgacccggtacccgtaaccgggtcccgtccccggttaccccccgg

SEQ ID NO: 150136 - DNA, 664 bp, Homo sapiens
  misc_feature: GYAE6OF01BK22H.44.86.H09.1.454.CMB.1.raw
tcagacagtatatacacgaccggtgctcgatttagtgctatagacttgggtttgggggggaagctctgcttcagctgtgagcgcagaaggcaggactcgggacaatcttcatcatgacctgcctccctctcctcctcacccttctcattcactgcgcgagggtcctgggcccagtcctgcattcgacgcaggcccgccctcgagtcgtctgccggccccagggacaggagcgtcgccatctccctggcctctaggaaacactccaatattgtacgtaatcatgtactataggtaaccaaaagtcgctggctccggaccctaagtcctactatttactgagtatcttacgacgccaactgactctcgtgtaccgattctctcgtcctactaacgtctaggtaaccttcgacgtccctactttcggaccctagtaccccgtacggaccttccgaacggtaccgttacgggaacgacggtacggaccgtaactttaaccgtagtttcggttacggggtcctttagggtaccttccggacgttcccggttggggttacgggttacgggggtttttccgggaccggggtaccgggtacccgtacggttccggaacccgttccgtaaacggtccgaccgtacccgtaacggcccgttcccggtacccccg

SEQ ID NO: 150137 - DNA, 716 bp, Homo sapiens
  misc_feature: GYAE6OF01CDI3E.44.86.H09.1.454.CMB.1.raw
tcagacagtatatacacgaccggtgctcgatttagtgctatagacttgggtttgggggggaagctctgcttcagctgtgagcgcagaaggcaggactcgggacaatcttcatcatgacctgctccctctcctcctcacccttctcattcactgcgcagggtcctgggcccagtctgcattgacgcagccgcctcagtgtctgccggcccaggacagagcgtcgccatcctcctgctctaggaaacaacctccaactagttggtacgtaatcattcgtacagtacggtaaccaaaagtcgactgcctccggaccctaaagtcctactatttactagtaagaactcgttacgaccggacccacgtggactctcgtcgaccgtattcctctcgtacctactaacgtcgtacggtaaccttcgaacgtccctacgtttacggccctaacgttacccgaaccggtacctcccgtaacggtaaccgttacgggaacgaaccgggtacggtaccccgttaagtttaaccgttaacggtttcgggttacggggtccgtttaacggggaccttacccggacggttcccggtttggggttcggggtttccgggggttttaccgggaccgggtaaccgggggtaccccgtacggttccggtaccccggttaccgttaaacggtccgacccggaccccgtaacgggtcccgtcccggttaccccccgg

SEQ ID NO: 150138 - DNA, 647 bp, Homo sapiens
  misc_feature: GYAE6OF01C9C46.44.86.H09.1.454.CMB.1.raw
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttctcattcactgcgcgagggtcctgggcccagtctgctattgacgcagccgcctnagtgtctggccggccccagggacaggacgccgtccgccacttccncctgcctcgtacggaaaccaacctaccaaactagttcggttacgtaactcattagttacacgtagtaaacctaaaagtcgctcggacctccggaccctaagtcctntattangagtatctagaccgtccgacctggactcgtcgtacgaccgtattcctctcgaccttacgtattcgtagtaccttacgactcctagttcgcctacgtccgacccgtactccgacgtacgtagggacgacggacgtaccgtagttaactaggttcggttcggtcggttacggtcctaccgtcggttccggtttgggttcgggttcgggggttttcggacggggtaccgggtacccgtacgtccggtacccgttaccgtacgtcgacgacccgtacggcccgtccggtacccccgg

SEQ ID NO: 150139 - DNA, 759 bp, Homo sapiens
  misc_feature: GYAE6OF01CWLLO.44.86.H09.1.454.CMB.1.raw
  modified_base (65)..(65): a, c, t, g, unknown or other
  misc_feature (65)..(65): n is a, c, g, or t
  modified_base (86)..(86): a, c, t, g, unknown or other
  misc_feature (86)..(86): n is a, c, g, or t
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
tcagacagtatatacacgaccggtgctcgatttagtgctatagacttggggtttggggggggaanctctgcttcagctgtgagcgnagaaggcaggactcgggacatcttcatcatgacctgcctccctctcctcctcaccctttcattcactgccgcgagggtcctcgggcccagtctgactagttcgaccgnaccgcccgacctgagtgtccncggacccggacccaggaactaggcgtccggtccaccctagtccctaccgtgtccgtaacgtaacggaaaccctaacctaacccgaattacggttacgggtaacttaactcgtaacgtttacgttaacgtaacgttaacggttaaaaacccgtaaaacggtccggtaccgttccgggtaccccgttaccccgggttaacccttaaacggttccccttagtttaacgtttaagtacggtaaacgttaacgttccggttaaccggacccgtaccccgtacgtacgtacttccgtacgtaccgtaccgtcttcgtctccgttacctagtacgtcgtaacggtactccgtacgtccgttacgtacacctaccgtccgaacccgtccttaccgaacgtcggtacggacggaccgtacggtaccttagttaaccggttggttcggttaccgggtgttaccgacgtcgtacggttcggtgggttcgggttcggtcgggacggtcgtaccgcgtacgccgtacctaggccacgccgtacgccgtcccgtcccg

SEQ ID NO: 150140 - DNA, 743 bp, Homo sapiens
  misc_feature: GYAE6OF01AQZQH.44.86.H09.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
tcagacagtatatacacgaccggtgctcgatttagtgctatagacttgggtttgggggggggaagctctgcttcagctgtgagcgcagaaggcaggactcgggacaatcttcatcatgacctgctccctctcctcctcaccttctcattcactcgcgcgagggtcctgggccctagtctgcattgacgcagcccgcctnagtntcgtcgaccggcccaggacagacgcgtccgcctactcgtcctaggcctctacggaaacacctacctaacgagtttacggtacgtaatactagttacgttaccaagtaacggtaacctaaaagtccgtacgtcggtaccgtacccggtaccctaaacggttcctacgtactttagtacgtaagtaacttacgttacggaccgtaccctaccgtaggacgttctaccgtacgtaccggttcttaccacgttccgtcccttaacgttaaccggttcctaacgggtacctttaacgtaccgtaccgtttaaccgtttcggaccttacgtaccgtaacccggacccttaccgaacgtaccggtaacggaccggtacggtacggtaccgtagtttacgtaaggtttcgggtacggttaccggttcggtacccgtacgtaccggttcggtttagggttcggggtttcggggttacccgggcgggtacgggaccgtacggacggtccgtaccgtagtccgaccgaccgacggtccgtcccggtacccg

SEQ ID NO: 150141 - DNA, 694 bp, Homo sapiens
  misc_feature: GYAE6OF02FYO28.44.86.H09.1.454.CMB.1.raw
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttctcattcactgcgcagggtcctgggcccagtctgcattgacgcagccgccctcagtgtctgccggcccaggacagagcgtcgccatctcctgctctaggaaacacctccaacattggtacgtaatcattgttacagtacggtaaccaaaagtcgcgtggcctccggacccctaaagtcctactatttatgaagtaattcgttacgaccggccctacgtggactctcgtcgaccgtattctctcgtccttactaacgtctacggtaaccttcgacgtcccttacgtttcggaccctacgtacccgaacccggtaccttaccgaacgtaccgttgggaacggtaaccggtacggtacccgttaagtttaaccgttagttttcgggttacggggttccgtttacgggtacccttccgtacggttccgtttggggttcggggtttcgggggtttccgggacggggtaaccgggtacccgtacggttaccggtacccgttaccgtaacggttccgaaccggtacccggtaacgggtccgtccccggtaccccccgg

SEQ ID NO: 150142 - DNA, 710 bp, Homo sapiens
  misc_feature: GYAE6OF02I1INM.44.86.H09.1.454.CMB.1.raw
tcagacagtatatacacgaccggtgctcgatttagtgctatagacttgggtttgggggggaagctctgcttcagctgtgagcgcagaaggcaggactcgggacaatcttcatcatgacctgctccctctcctcctcacccttctcattcactgcgcagggtcctgggcccagtctgtgatgtctcagccaccctcagcgtcgtcgggacccccgggcagggggtccaccatcctcttgtctggaaggagtccaatatcggatctatcctgtcaactggtatcggggactccgaggtccacccggcccccgacttcccttatcctatgctactaatcagcgccctacgacggggtccctgcccgtacttcctcgtaggcctaccgaagtctggcctaacgtaccaaggtcctaacccgtcggtaccctaagttcccgtttagtaacttccttaccctaggttaccctagggtaaggtacttagggaccggttacttaggttttaacccttaacgttcggttacgaccgtaggtaccgtaaggttaggggacttaaggaacccggtacgggaccccgggggtaaacgggtccgggttgggggttaaccggtttcccggggggaccgggaaaccggggtacctaaaccgggttccggaaccccggtttcccgttaagggacccgtaaccgggaccccgtaacgggtaccccgg

SEQ ID NO: 150143 - DNA, 734 bp, Homo sapiens
  misc_feature: GYAE6OF02GXZ5E.44.86.H09.1.454.CMB.1.raw
tcagacagtatatacacgaccggtgctcgatttagtgctatagacttgggtttgggggggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgcggccccaggacagagcgtcgccatctcctgctctggaaacaactccaacattggtcgtaatcatgttacatggtaaccaaaagtcgctggctccggacccctaaagtcctactatttatgagtaattcgttagaccggcccaccgtggactctcgtacgaccgtattctctcgtccttacgtaacgtctaggtaaccttcacgtcctacgtttcggacctactaccgaacccggtaccttaccgaacgtaccgacggaacggaccggtacgggacccgttaagtttaacccgtttaaggttttcgggttacggggttaccggtttacggggtaaccctcccggttaacgggttcccggttttgggggttacggggttttcggggggtttttcccgggaccgggggtaacccgggggtaccccggttaaccggttcccgggtaaccccggtttacccgttaaacgggttcccgtaaccgggtacccccggtaacggggtccccgttacccgggttaccccccccgggg

SEQ ID NO: 150144 - DNA, 667 bp, Homo sapiens
  misc_feature: GYAE6OF02IAHRI.44.86.H09.1.454.CMB.1.raw
  modified_base (371)..(371): a, c, t, g, unknown or other
  misc_feature (371)..(371): n is a, c, g, or t
tcagacagtatatacacgaccggtgctcgatttagtgctatagacttgggtttgggggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgcggccccaggacagagcgtcgccatctcctgctctggaaacaactccaacattggtacgtaatcattgttacattacggtaaccaaaaagtcgacttggcctccggaccctaaacgtcctactaatttatagagaatcttagacggcccacctgatctctgaccgtntctctcgtcctctagtctagactttacacgtcctacgtttcgacctactaccgacccggtacttcccaacgtacgaggtaacggaccggacggtaccgtaagtttaaccttaagttcggtttaggggtccgttacggggacctttcccgaaggttcccgtttaggggttacgggtttggggttttacccggggacggggtaaccggggtaccccgtaacggttccggtaacccggttaccgttaacggttaccgaacggtacccccggaaggtccccgttaccggtcccccccggg

SEQ ID NO: 150145 - DNA, 489 bp, Homo sapiens
  misc_feature: GYAE6OF02JDU1I.44.86.H09.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (292)..(293): a, c, t, g, unknown or other
  misc_feature (292)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (331)..(332): a, c, t, g, unknown or other
  misc_feature (331)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
tcagacagtatatacacgaccggtgctcgatttagtgctatagacttggggtttggggagttggcatactactactacggtatggacgtctggggccaagggaccacggtcaccgtctcctcagcttccaccaagggcccaagtccggtctttccccctggcgcccctgcgtccaggacgcaacctctgggggcacagcgaccctgggctgcctggtcaaggctactccacgtcactgctgagcggntggcaaggcgacatagnannangntatcgatcnangcagctcncnncncncncncncacacgctcncgtcncncgcnctctcgnncncncgcgcgancgcgcgcgcgcgcgtacgtacgacgtactacgtacgtacgacgacgtacgacgtacgacgtacgtcgtacgtacgtacgacgacgtacgacgcgtagcgtanacgtcngtacgacgacgtacgtacgtacgacgtacgacgtacg

SEQ ID NO: 150146 - DNA, 712 bp, Homo sapiens
  misc_feature: GYAE6OF02GMMB0.44.86.H09.1.454.CMB.1.raw
tcagacagtatatacacgaccggtgctcgatttagtgctatagacttgggtttggggggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggccccaggacagacgcgtcgccatcctcctgctctaggaaaccaactccaacattggtacgtaatcatgttacatcggtaaccaaaagtcgctggcctccggacccctaaagtccctctaatttatagagtaacttcgttaacgacccggacccacgtggtactctcgtacgaccgtattcctctcgtccttactagtcgtacggtaactcacgtaccttacgtttcgacctacgtccgacccggtacctaccgacgtacgtacgggaacgaccggtacggtacccgttaatttaaccgttagtttcgggttacgggtaccggtttacgggtacccttcccgtacggttccggttttaggggttcggggttttcggggggttttacccgggaccgggggtaaccggggttaacccccggtaccggttacccgggtaccccggtttacggtaacggttcccgaaccggtaccccgaacgggtcccgtaccccggttccccccggg

SEQ ID NO: 150147 - DNA, 627 bp, Homo sapiens
  misc_feature: GYAE6OF02HC4AT.44.86.H09.1.454.CMB.1.raw
  modified_base (477)..(477): a, c, t, g, unknown or other
  misc_feature (477)..(477): n is a, c, g, or t
  modified_base (516)..(516): a, c, t, g, unknown or other
  misc_feature (516)..(516): n is a, c, g, or t
tcagacagtatatacacgaccggtgctcgatttagtgctatagacttgggtttggggggggaagctctgcttcagctgtgagcgcagaaggcaggactcgggacaatcttcatcatgacctgctcccctctcctcctcacccttctcattcactgcgcagggtcctgggcccagtctgtgatgtctcagccaccctcagcgtctcgggacccccgggcgacggggggtccaccatcttcttgttctggaaggaagtccaatatcggatcttatcctgtcaacgtggtagtcggggactcccaggccgaccggccccccgactccttatctactcgacttactaatcagccgccctcgacggggtccctcgcccgattctcgtcggcctccaagttccgtggccacgtacgaggtacctacccgtggccctagttcccttggacttcctacctagttcctggtaggacttggacggtnttacggtatttaacgtacgtgtcgcgagctagtgggtanaggaccgtacggacccgggtacgtcggttggggtcggttacgggacggggaacgggtaaccgtaggtttacgtacgttccggttaccgtacgggtaccacggtaaccccgg

SEQ ID NO: 150148 - DNA, 694 bp, Homo sapiens
  misc_feature: GYAE6OF02IAXVH.44.86.H09.1.454.CMB.1.raw
  modified_base (336)..(336): a, c, t, g, unknown or other
  misc_feature (336)..(336): n is a, c, g, or t
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttctcattcactgcgcagggtcctgggcccagtctgcattgacgcagccgccctcagtgtctgccggccccaggacagacgccgtcgccatcctcctgctctaggaaacaactccaactagttcggtcgtaatcatgttacagtaggtaaccaaaagtcgacgtggcctccggaccctaacgtcctactatttangagtaatcgttagaccgcccacgtgatctctacgaccgtacttactctcgtaccttacgtaagtcgtacgtacttcgactcctacgtttcgacctactacccgtaacccggtacctaccggtaacgtacggtacgggaacgtaccgggaacggtccggttaactttaaccgtttacgtttagggtttccgggggttacgtttacggggtacccttaccgtaccgggttccgtttggggttcggggggttttcggggttttccgggacccggggtaacggggtacccgtacggttcccggtaccggttacccgtaaggttccggacggtaccccgacgggtcctcccggtaccccccgg

SEQ ID NO: 150149 - DNA, 734 bp, Homo sapiens
  misc_feature: GYAE6OF02IL571.44.86.H09.1.454.CMB.1.raw
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttctcattcactgcgcgagggtcctgggcccagtctgcattgacgcagcccgccctgagtcgtctcgccggaccccgagggaccaggcgtccgtccgccacttcctccgtgcctcgtacggaaacctaaccgtcccaaactagttcggtacgtaactccattcgttacacgtacggtaaaccaaaacgtcggacgtcggtccgtaccggtaccccgttaaacgtccttactaagttttataggtaacgtaacttacgtaacggaccggcccgtaaccgtcggtactaccgtacgtacgtacccggtatttccgtactccgtaccttacgtttaacggttccgtaacgtaaccctttaccgtacggtaccctttacgtttaccggaccttacgtacccgtaacccggtacctaccgtacgtacgtcgggaacgtaccggacggtaccgtaattaacgttacggtttacggttacgggtcggttacgggtacctaccggtacggtcgtttgggtcgggtttcgggtttccgggacgggtacgggtaccgtacgtccgtacgtactacgcgtaccgaccgacgtccgtcgtccccg

SEQ ID NO: 150150 - DNA, 604 bp, Homo sapiens
  misc_feature: GYAE6OF02F02UH.44.86.H09.1.454.CMB.1.raw
  modified_base (145)..(145): a, c, t, g, unknown or other
  misc_feature (145)..(145): n is a, c, g, or t
  modified_base (328)..(328): a, c, t, g, unknown or other
  misc_feature (328)..(328): n is a, c, g, or t
tcagacagtatatacacgaccggtgctcgatttagtgctatagacttgggtttggggggggaagctctgcttcagctgtgagcgcagaaggcaggactcgggacaatcttcatcatgacctgctccctctcctcctcacccttcncattcactgcgcagggtcctgggcccagtctgcattgacgcagccgcctcagtgtctgccggccccagggaccagacgcgtcgcctatcctcctgcctctggaaacaactccaacattggtcgtaatcatgttacatggtaaccaaaagtcgctggctcggacccctaaagtcctacatttangtagtaatcttagacgacccacgtggactctctgacctattctctcgtcctactagtctagtaaccttcagccctacgttcgaccactccgaccggaccttccgaacgcttaggacgacgtaggcctagtttaactagtttgttacgggtccgtttgggaccttcgacgttccgttagggttgggtttcggggtttcggcgggacgggtaacccgtacggtacggacccggttaccgtacggtccgaacggcccaacgggtccgtccggtcccccg

SEQ ID NO: 150151 - DNA, 558 bp, Homo sapiens
  misc_feature: GYAE6OF02GILQS.44.86.H09.1.454.CMB.1.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (532)..(558): a, c, t, g, unknown or other
  misc_feature (532)..(558): n is a, c, g, or t
tcagacagtatatacacgaccggtgctcgatttagtgctatagacttgggtttgggggggcagagggtcaccatctcctgcactgggagcagatccaacatcgggacagattctgatgtccactggtaccaacaccttccaaggaacacgccccccaaactccctcattcctttaggtaaaccaactactccggcccctgacggggtcccctgaccgattctctggctcaagtctagcaccgtcacgcctcctcggccatcacgtgggcctcgacgctagaacgagtggtaggtntaacttatactcgcctagtcctagacgacacnctacgctcgtaggttggttgggtcgttacgggcggtacggaccagtcgtacgtaccgttcgtcggtcgaccgacccgacggtcctcccggcccgtcgtctaccgttcccgttaccgtcccccgtccttccgttactacttaactccgtcgtcggtacgcgggtcccgtgtaccggcggtaaccgcgtacctgtacgnctgnctgnnnnnnnnnnnnnnnnnnnnnnnnnnn

SEQ ID NO: 150152 - DNA, 362 bp, Homo sapiens
  misc_feature: GYAE6OF01B16QM.36.17.B06.1.454.CMB.1.raw
  modified_base (356)..(362): a, c, t, g, unknown or other
  misc_feature (356)..(362): n is a, c, g, or t
tcagtacgctgtctcacgaccggtgctcgatttagtcgatagtgaagggccggttcatctcttcccgagacaattccaggaatgcactgtttctgcaaatgaacaacttaagagtcgatgacacggccgtctacttctgtgcgaaagattttgatagcagtagttcgaatcatgatccggttggcttctggggccagggaaccctggtcattgtctcctccgcctccaccaagggcccatcggtcttcccctggcgccctgctccaggagcacctccgagagcacagcggccatgggctgcctggtcaaggactacttccagacagcgtactgagcgggctggcaaggcgcatagnnnnnnn

SEQ ID NO: 150153 - DNA, 379 bp, Homo sapiens
  misc_feature: GYAE6OF01D0CFF.36.17.B06.1.454.CMB.1.raw
  modified_base (365)..(379): a, c, t, g, unknown or other
  misc_feature (365)..(379): n is a, c, g, or t
tcagtacgctgtctcacgaccggtgctcgatttagtcgatagtgaagggccggttcatctcttcccgagacaattccaggaatgcactgtttctgcaaatgaacaacttaagagtcgatgacacggccgtctacttctgtgcgaaagattttgatagcagtagttcgaatcatgatccggttggcttcgtggggccagggaccctggtcagttgtctcctccgcctccaccaagggcccatccggtccttccccctggccgccctgctccaggagccacctccgagagcacagcggccatgggctgcctggtcaaggctactccagacagcgtactggacgcgggctggcaagggccgcataggnnnnnnnnnnnnnnn

SEQ ID NO: 150154 - DNA, 360 bp, Homo sapiens
  misc_feature: GYAE6OF01ERY5Z.36.17.B06.1.454.CMB.1.raw
  modified_base (357)..(360): a, c, t, g, unknown or other
  misc_feature (357)..(360): n is a, c, g, or t
tcagtacgctgtctcacgaccggtgctcgatttagtcgatagtgaagggccggttcatctcttcccgagacaattccaggaatgcactgtttctgcaaatgaacaacttaagagtcgatgacacggccgtctacttctgtgcgaaagattttgatagcagtagttcgaatcatgatccggttggcttctggggccagggaaccctggtcattgtctcctccgcctccaccaagggcccatcggtcttccccctggcgccctgctccaggagcacctccgagagcacagcggccctgggctgcctggtcaaggactacttccagacagcgtactgagcgggctggcaaggcgcatagnnnn

SEQ ID NO: 150155 - DNA, 470 bp, Homo sapiens
  misc_feature: GYAE6OF02GE85X.36.17.B06.1.454.CMB.1.raw
  modified_base (123)..(123): a, c, t, g, unknown or other
  misc_feature (123)..(123): n is a, c, g, or t
  modified_base (138)..(138): a, c, t, g, unknown or other
  misc_feature (138)..(138): n is a, c, g, or t
  modified_base (150)..(150): a, c, t, g, unknown or other
  misc_feature (150)..(150): n is a, c, g, or t
  modified_base (391)..(391): a, c, t, g, unknown or other
  misc_feature (391)..(391): n is a, c, g, or t
  modified_base (437)..(470): a, c, t, g, unknown or other
  misc_feature (437)..(470): n is a, c, g, or t
tcagtacgctgtctcacgaccggtgctcgatttagtcgatagtgaagggccggttcatctcttcccgagacaattccaggaatgcactgtttctgcaaatgaacaacttaagagtcgatgacncggccgtctacttcngtgacgaaagtnttttgatagcagttagttcgaatcatgatccgggttggcttcgtcgggggacccaggggtaaccctggtactattcgtccttccctccgccctaccgaccgaacgggcccctagttccggttcccttcccccgtggcccgaccctgcctacgaggacgccacccgtcccggagacgacaccacggccggcccgtggggcctggcccgtggtacaacgggtactactttccgaagaccgacnccggtaactggaggaccggggctagggccgaaggcccgcataggcnnnnnnnnnnnnnnnnnnnnnnnnnnnnnnnnnn

SEQ ID NO: 150156 - DNA, 436 bp, Homo sapiens
  misc_feature: GYAE6OF01C6G1D.10.77.G11.1.454.CMB.1.raw
  modified_base (431)..(436): a, c, t, g, unknown or other
  misc_feature (431)..(436): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttcccctggcaccctcctccaagagcacctctgggggcacagcggccctgggctgcctggtcaaggactacttcccactactatgctgagcgggctggcaaggcgcatagnnnnnn

SEQ ID NO: 150157 - DNA, 536 bp, Homo sapiens
  misc_feature: GYAE6OF01C4SAE.10.77.G11.1.454.CMB.1.raw
  modified_base (203)..(203): a, c, t, g, unknown or other
  misc_feature (203)..(203): n is a, c, g, or t
  modified_base (412)..(412): a, c, t, g, unknown or other
  misc_feature (412)..(412): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccagggggaancgccacctctcctgcagggccagtcagagtctaggagctccttagcctggtactcaacagaaacctggaccaggcctcccaggcctcctcatctatgatgcataccaacgagggccacgtggacactcccaggcctaggttccaggtcggctaggtcgggtctgggacagtacttcactctacaccatcagcagactagagctagaatntttgacttagtttattactgtcagtcagtcgtagctaacgtcggtcctcgggtacgttcggacgaacggaccgaaaggtcgacagtacgaagcgtacgtggtgctcgacacctatcgtgttacc

SEQ ID NO: 150158 - DNA, 603 bp, Homo sapiens
  misc_feature: GYAE6OF01BVQBR.10.77.G11.1.454.CMB.1.raw
  modified_base (201)..(201): a, c, t, g, unknown or other
  misc_feature (201)..(201): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccaggggaanagccacctctcctgcagggccagtcagagtcttaggagctccttagcctggtatcaacagaaacctggaccaggcctcccaggcctcctcatctatgatgcactcccgaacgacgggccacgtggcctactccccgaagccgtaggttcaggtggcgtaggtcgggtctggggacaggtacctttcgacttcgtaccaaccattaccagtaccaagacctaaggacgtcccgtagtaagtattttgacttaaggttttacttacgtgtacagctaggcgtagactaacgtcggaccttcgggtacgttccggaccgaacgggaacctaaaggtcggaactacgtacgaaaggacgtaaccgtaggtcggacttccgaccgtacctacgttcgtacggttccc

SEQ ID NO: 150159 - DNA, 511 bp, Homo sapiens
  misc_feature: GYAE6OF01BWQNK.10.77.G11.1.454.CMB.1.raw
  modified_base (203)..(203): a, c, t, g, unknown or other
  misc_feature (203)..(203): n is a, c, g, or t
  modified_base (503)..(503): a, c, t, g, unknown or other
  misc_feature (503)..(503): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccactggcatcccagccaggttcagtggcaggtggtctgggacagacttcactctcaccatcagcagactagacgcctagaagtattttgctagtttattactgtcagcagcgtagcaacgtcgggccgtcggtacgttcggaccgaacgggaccgaagtggacagtcaagacgactgtggctgccaccntcgtgtcc

SEQ ID NO: 150160 - DNA, 440 bp, Homo sapiens
  misc_feature: GYAE6OF01CMJWP.10.77.G11.1.454.CMB.1.raw
  modified_base (433)..(440): a, c, t, g, unknown or other
  misc_feature (433)..(440): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatccggtcttccccctggcacccctcctccaagagcacctctgggggcacagcggcctgggctgcctggtcaaggactactcccactactatgctgagcgggctggcaaggcgcatagnnnnnnnn

SEQ ID NO: 150161 - DNA, 517 bp, Homo sapiens
  misc_feature: GYAE6OF01DQ028.10.77.G11.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccaggggaanagccaccctctcctgcagggccagtcagagtcttaggagctccttagcctggtatcaacagaaacctggccaggctcccaggctcctcatctatgatgcatccaacngggccactggcatcccagccaggttcagtggcaggtggtctgggacagacttcactctcaccatcagcagactagacgcctgaagtattttgactagttttattacgtgtcagcagcgtagcaacgtcggcctcgggacgttcggaccgaagggaccaaggtggacagtacgaagcgtaacgtggtgcgtcgacacctatcgtgttacc

SEQ ID NO: 150162 - DNA, 471 bp, Homo sapiens
  misc_feature: GYAE6OF01ARDOI.10.77.G11.1.454.CMB.1.raw
  modified_base (463)..(471): a, c, t, g, unknown or other
  misc_feature (463)..(471): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggggcaagtggacgtcgtggggccaagggaccacggtcaccgtctcctcacgcctccaccaagggcccatcggtccttccccctggccacccctcctccaacgacgccacctccgtggggggccaccgaacggccgggcccctggggccttggccctgggtcaaggctaccttcccactactatgctgagcgggctggcaagggcgcatagnnnnnnnnn

SEQ ID NO: 150163 - DNA, 460 bp, Homo sapiens
  misc_feature: GYAE6OF01CGNY3.10.77.G11.1.454.CMB.1.raw
  modified_base (446)..(460): a, c, t, g, unknown or other
  misc_feature (446)..(460): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggggcaagtggacgtctggggccaagggaccacggtcaccgtctcctcagcctccaccaagggcccatccggtccttccccctggccaccctcctccaagacgcacctctgggggcacagccggccctgggctgcctggtcaaggactacttcccactactatgctggagcgggctgggcaacgggcgcatacgnnnnnnnnnnnnnnn

SEQ ID NO: 150164 - DNA, 458 bp, Homo sapiens
  misc_feature: GYAE6OF01CJZU3.10.77.G11.1.454.CMB.1.raw
  modified_base (428)..(428): a, c, t, g, unknown or other
  misc_feature (428)..(428): n is a, c, g, or t
  modified_base (447)..(458): a, c, t, g, unknown or other
  misc_feature (447)..(458): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccggcggggggggcaagtggacgtcgtggggccaagggaccacggtcaccgtctcctcagcctccaccagggcccatccggtccttccccctggccacccctccctccaagacgccaccgtcgtgggggcacaggccggccctgggctcgcctggtcaaggacctaccttcccactactatgctgngcggctggcagcgcatagnnnnnnnnnnnn

SEQ ID NO: 150165 - DNA, 541 bp, Homo sapiens
  misc_feature: GYAE6OF01B2U8K.10.77.G11.1.454.CMB.1.raw
  modified_base (347)..(347): a, c, t, g, unknown or other
  misc_feature (347)..(347): n is a, c, g, or t
  modified_base (533)..(533): a, c, t, g, unknown or other
  misc_feature (533)..(533): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggctcctcgtatatggtgcatcccaccgacgggcccacgtggtactctcgaggcctaggttccgnggcaggtggggtctgggacaggagttcactgtcacatcagcagctgcagtctagaagtatttgactagtttattactgtctagctagttataatagtcgtacggcccgtaggtacgttccggaccgtaagggaccggtagggtacggtaacgttacgaaacggtacgtggtaggcgtacgccaacntcgtgttc

SEQ ID NO: 150166 - DNA, 440 bp, Homo sapiens
  misc_feature: GYAE6OF01B9JYG.10.77.G11.1.454.CMB.1.raw
  modified_base (433)..(440): a, c, t, g, unknown or other
  misc_feature (433)..(440): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctacaaatgaacagcctgagagccgacgacacggccgtatattactgtgcgaaagatacgtggacacatgtatggtccgcgggggggggcaatggacgtctggggccaagggaccacggtcaccgtctcctcagcctccaccaagggcccatcggtcttccccctggcaccctcctccaagagcacctctggggcacagcggccctgggctgcctggtcaaggactacttcccactactatgctgagcgggctggcaaggcgcatagnnnnnnnn

SEQ ID NO: 150167 - DNA, 506 bp, Homo sapiens
  misc_feature: GYAE6OF01DVSFV.10.77.G11.1.454.CMB.1.raw
  modified_base (482)..(506): a, c, t, g, unknown or other
  misc_feature (482)..(506): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtgggtccgggcggggggggacaagtgggacgtcgtggggccgaaagggaccacggtcaccgtctcctcacgcctccaccgaacgggcccatccggtccttcccccgtggccacccctcctacccaagacgcaccgtcgtcggggcacgaggccggcccgtgggctcgccgtggtacaacggtccttacctacccactactatcgcgtggacgcgggcgtcggacgaacgggcgacgaagtgannnnnnnnnnnnnnnnnnnnnnnnn

SEQ ID NO: 150168 - DNA, 575 bp, Homo sapiens
  misc_feature: GYAE6OF01B3RHN.10.77.G11.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (566)..(566): a, c, t, g, unknown or other
  misc_feature (566)..(566): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanacgccaccctctcctgcagggccagtcagagtctagganctcctagcctggtatcaacagaacctggccaggcctcccgaggcctcctcatctatgatgcactccaacgacggccacgtggaccactccccagcccgtaggttccaggtcggcgtagggttcgggtcgtacggggaactacggtaccttcgaccttcctaccaacctatcacgacacgactagacgtaccgtagaagttattttcgacttagttttattacgtgtcagctagcgtagacgtacgtcggtccgtacggtacgtcggaccgaacggaccgaaggtacgactagtacgaagacgtacgtggtcgcgtcgacaccnctcgtcgtc

SEQ ID NO: 150169 - DNA, 705 bp, Homo sapiens
  misc_feature: GYAE6OF01B8HPO.10.77.G11.1.454.CMB.1.raw
  modified_base (203)..(203): a, c, t, g, unknown or other
  misc_feature (203)..(203): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangccaccctctcctgcagggccagtcagagtcttaggagctccttagcctggtatacaacagaaacctggaccaggcctcccaggctcctcactctatgatcgctactacccaacgcgggaccacgtcggaccactcccaagccgtaggttcaaggtcggacgtagggttcgggtacgtacggggaactaacgtaccgtttcaaccgttctacccacctaacttccgaacgacctaagtaaccgtaaggacgtacccgttaaggtaacgttagtttttacgactttaagtttttaacttacgttgtacctaggtaccgtaaggtcgtaacgaccgtaaacggttcggggtcccgttaacggggtaccgttacccgggaacccggtaaaccgggtaaacccgttaaagggtaccggaaaccgtaacgtaccggaaacgggtaccggttaaacggtcgggttacggaccgtacgaccgtaacccttacgttccgttcgtttaccc

SEQ ID NO: 150170 - DNA, 518 bp, Homo sapiens
  misc_feature: GYAE6OF01BEQYQ.10.77.G11.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (305)..(305): a, c, t, g, unknown or other
  misc_feature (305)..(305): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccaggggaangccaccctntcctgcagggccagtcagagtctaggagctccttagcctggtatcaacagaaacctggccaggctcccaggctcctcatcatgatgcatccaacngggccacgtggcactcccagccaggttccaggtggcgaggtcgggtctgggacagcttcactctcacatcagcagactagacgcctagaagtatttgcgtagtttatactgtcagtcagtcgtaagcaacgtcggtcctcgggcgttcggacgaacggaccgtaaggtcggacagtacagacggaactggtggctcggactacactctgttcc

SEQ ID NO: 150171 - DNA, 511 bp, Homo sapiens
  misc_feature: GYAE6OF01BWC15.10.77.G11.1.454.CMB.1.raw
  modified_base (483)..(483): a, c, t, g, unknown or other
  misc_feature (483)..(483): n is a, c, g, or t
  modified_base (485)..(487): a, c, t, g, unknown or other
  misc_feature (485)..(487): n is a, c, g, or t
  modified_base (489)..(511): a, c, t, g, unknown or other
  misc_feature (489)..(511): n is a, c, g, or t
tcagcatagtagtgcacgaccggtgctcgatttagctagtcactcaagggaaaggggctggagtgggtctcaggtattagtggtagtggtgatggcacatactacgcagactccgtgaaggccggttcagcatctccagagacaattccaagaacacgttggatctacaaatgaacagcctgagagccgacgacacgccgtatattactgtgcgaaagatacgtggacacatgtatggtccgggcggggggggacaagtggacgtcgtacggggaccaaggggacccacgggtcacccgtctcctcgacgcctccaaccgaacgggccccagtccggttccttcccccgtggcccacccctcctaccaacgagcccacctccggtggggcacgacggccggccgtcggctcgccgtggacgtaagacctaccgttcccactactatcgcgtcgaggtcggcgtgggacgacggcgacgatgangnnngnnnnnnnnnnnnnnnnnnnnnnn

SEQ ID NO: 150172 - DNA, 525 bp, Homo sapiens
  misc_feature: GYAE6OF01B01S4.10.77.G11.1.454.CMB.1.raw
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (507)..(525): a, c, t, g, unknown or other
  misc_feature (507)..(525): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtatgggtccgggnggggggggcaagtggaccgtgtggggccgaagggaccacggtccaccgtctcctcaggccctccgaccgaacgggccccagtccggtcctttccccctggcccaccccgtccctccaacgngcctaacctcggtcggggccacgtacggcccggtcccgtgggcctcgtccgtggtaccaacgggtaccttaccttcccctaactaccttatcgcgttacgacggcgggtcgtcggaccgacggcganacgtancgtnnnnnnnnnnnnnnnnnnn

SEQ ID NO: 150173 - DNA, 703 bp, Homo sapiens
  misc_feature: GYAE6OF01D9X2N.10.77.G11.1.454.CMB.1.raw
  modified_base (664)..(664): a, c, t, g, unknown or other
  misc_feature (664)..(664): n is a, c, g, or t
  modified_base (667)..(668): a, c, t, g, unknown or other
  misc_feature (667)..(668): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (682)..(688): a, c, t, g, unknown or other
  misc_feature (682)..(688): n is a, c, g, or t
  modified_base (691)..(698): a, c, t, g, unknown or other
  misc_feature (691)..(698): n is a, c, g, or t
  modified_base (700)..(703): a, c, t, g, unknown or other
  misc_feature (700)..(703): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaaagaacacgttggatctgacaaatgaacagcctagagacgccgacgacgacggccgtatattacgtgtgacgaaagatacgtagaccactagtagtacgttcgggtccggggcgggggggacaaaggttcgggaccggtcggtcggggacccgtaacgggacccgtaacggtccgtaaccgtcctcccgtcgaccgtccctaccgaacccggaaccgggtcccctaccgggttccccgtttcccgtttccccccgtacgggtaccccctaccccgtttaccccaacccgtaaacgaccgtcccgtaacccgttccgggtacggggaacccaccggtacggccccggtaccccggtcggggtcccgttaccggccggttacgggttaaccgaaacggtttaacccgtttacccgttaccctaacgttaccgttagttccggtacgtacggggaccggtccggggtacgtaccgggaacccgaacgggtccgtacggtacgttacggactgaacngcnncngngcncgcgcgnnnnnnngcnnnnnnnnannnn

SEQ ID NO: 150174 - DNA, 827 bp, Homo sapiens
  misc_feature: GYAE6OF01DBBS7.10.77.G11.1.454.CMB.1.raw
tcagcatagtagtgcacgaccggtgctcgatttagctagtcactcaaggggaaagggggaggaactgctcagttaggacccagagggaaccatggaagccccagctcagcttctcttcctcctgctactctggctcccagacttccaccggagaagttgtgttgacacagtctccacgcccaccctgtctttgtctccgaaggggaaagcgcccaccctctcctgccacgggccagtcagtagttcgttagggacgtccttaccgttaggcccgtaggttaactaccaaacgaaccggtaaaacccgtcggacccgaacgggccctaccccgacgggtcccttaccccgtactacgttactacgttaggaactcgacctaaccgtacccgaaacggaccgggacccaccggtacggaccacccgtaccccgaacggtccgtaacgggttcgacgggttcggaccgggtagggttcggggtcggttaacgggaacgtaccgttaaccgtttacccgacctttaccctacctaacccgtattaaccgacgacccgtaaacgtaacccggtaagtaccggtacccgtaaggtaacgtttacgtttaacgtaccgttttaagttttactaccgtacgtacgacgtacggtacgtccgtaccggtacccgttaccgggtttacgggcgggttaacggtcccgtaccggttaccgggttacgggaccggggtaaccgaaaacgtaaacggtaacggtaacggtaaacccaacgggtacccgttagggaccgttaaccgtcggtaacccaccgttgttaccggttatttacccc

SEQ ID NO: 150175 - DNA, 778 bp, Homo sapiens
  misc_feature: GYAE6OF01A3BZ1.10.77.G11.1.454.CMB.1.raw
  modified_base (444)..(444): a, c, t, g, unknown or other
  misc_feature (444)..(444): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctgctcccagattccaccggagaagttgtgttgacacagtctccacgcccacccttgttctttgtcctccgtagggggaaacacgcccacccctctcctgcgacgggccaagtcagtagtcttaggacgtctccttagcctggtactacaacgaacgaaccgtggaccgaggcctccgacggccttcctcaattcctagtcgagtcgacactacccaacgaaccgggaccacggttcgtacctaccccaggccccgttaaggtaccgtagggtcggcgtaagggtcggggtacgtacgggacaaggtacggttccncgttccaaccgtaccgtatacccgagaccgtagtcgtagtaccgtacggttacgtaagtaacgttacgttttacgacgtttaaggtttttaactacgtacggtttaaccgaaagggtttaaactttaggtaacgtacggtttacgggtcgtacggggttaccctttaccgtacggtttaacgtttacccgggaaccgggtaaacgggttaccgttaaacggggttacggtaaccctaaacgttaaacccggaaaaacgggtttcgttacgggtacccggtccggttaaaccggtaccttaacccggttacgttaccggtttccccgttttaaac

SEQ ID NO: 150176 - DNA, 624 bp, Homo sapiens
  misc_feature: GYAE6OF01DCJ7B.10.77.G11.1.454.CMB.1.raw
  modified_base (131)..(131): a, c, t, g, unknown or other
  misc_feature (131)..(131): n is a, c, g, or t
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (437)..(437): a, c, t, g, unknown or other
  misc_feature (437)..(437): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
tcagcatagtagtgcacgaccggtgctcgatttagctagtcactcaagggaaagggtgtacacctgtggttctcgggctgccctttggctttggagtattggttttctacggaaggggctggagtggtctnaggtattagtggtagtggtgatgcacatactacgcagactcgtgaacggtccgtnagcatcncaganacattccaaagacacgttgactntagacaatcgaaacngaccngaacgacgccgaacgacgacgtaccgtattaattacgtgtagaacgaaagtanacgtagacacaagtggtaacgcgggtacgggcggggacaagtcggacgtggtacgggaccgaacggacctacggtcctacgctacctcgaccaccctaccgaccgaacgtcccgacgtccgtccctacccgtcgaccctaccncccgtacgaacgccgacctaccgtacggacgggacctacgcggccggaccgtggacctcgggtaccgtacggtaaccgtacgtaacccttaccctaccgactaaccgtagtcgacgtacgacgggccggtcgaacggcgtaaaacggccaaccgtagtagacactagngnacnaganananacngnn

SEQ ID NO: 150177 - DNA, 1026 bp, Homo sapiens
  misc_feature: GYAE6OF01EAT9Y.10.77.G11.1.454.CMB.1.raw
tcagcatagtagtgcacgaccggtgctcgatttagctagtcactcaaggggaaagggggaggaactgctcagttacggaccaggaggaaccatggaacgccccagctcacgtctttctcttccctcctgccttactcgtcggcctacccgagtacttaccgacgggtagtaagtttggtgttagactactacgtcctccacgtaccctacccttgtttcctttggtccctaccggaaaggggaaacgacgaccccctacccttcctcccgtaggccgaacggggccctagtaccgaaggtagttcgttccgtactacggttttcgggtttaacggggtggttaacacgtaaaccgtaagttaaacccggtccggacccgacggtccctacccgacggttcctcctacttactttccgttttagactttaccggtttacctttaacccggaaccgggtccccggggttccccgtacgggtacccggtacccggacggttcgtaacgggttcgtaacggggtcggtacgtacggggttggggtacggacggtaacctaaggttaccctttaccgaccgttaccctacccgtaaccgtacctaccggacccgtaccgtaaaccggtaccggttaccggtaaccgttaacggtttaacggttaaacggttttaccggtttttaacggttaaccgttttttaaaggttttaaccttttacgtaagggtttaccccgtaaaggtttaaccgttaaaggttttaagttaacccgggttaccgggttaccgggttacccgggaacccgggttaacggggtttaacccggggttaccggggaaaccggggggttaaaccggggttaaaccggggtttaacgggtaaccgggtttaaaccgtaaaccggttaaaccgggttaggttacccggtacgggtttaccgccgttaaccgttaccgggaccttttaccgggttccctttaccggttacccttacggttttacccccctaccggttccttccgttaaccccg

SEQ ID NO: 150178 - DNA, 740 bp, Homo sapiens
  misc_feature: GYAE6OF01BMMKV.10.77.G11.1.454.CMB.1.raw
tcagcatagtagtgcacgaccggtgctcgatttagctagtcactcaagggaaagggggaggaactgctcagttaggacccagagggaaccatgggaagccccagctcagcttctcttcctcctgctactctggctcccagaaaccaccggagaagttgtgttgacgcagtctccaggcaccctgtctttgtctccgaggggaaagacgccacccttctccctgcacggggcctagtcctacttattttagtgacaactacttagccttggtgttcacgcaaccaaaccgtcggccaggcctcccaggcctcctcattcctatggcttgcctatcccagtccgacggggcccctaagtcgggacctacgtacccccgaagggacctaaggtactttaccggaggttccggggacggtaaggggttcggggttccgtagggggtaaccctagggttaccctttcgaacccgttccttacccgaacccgtaactccgaacgtaccgaacgtaccggttagggaccgtaccgtaggtaacgttattttcggtacgtagtttagttactttagttcggtactagtactaagttaggtacgggtacgttacgtaccggttagggtaccgttttcgggaccgtaaggggtacccgtaaggtacggtacgggtaaggtaacgttaaccgaaaacggttaccgttacggttaaccgggctaaccggtacctaaccgtacggtttacccg

SEQ ID NO: 150179 - DNA, 783 bp, Homo sapiens
  misc_feature: GYAE6OF01B0INX.10.77.G11.1.454.CMB.1.raw
  modified_base (761)..(761): a, c, t, g, unknown or other
  misc_feature (761)..(761): n is a, c, g, or t
  modified_base (775)..(775): a, c, t, g, unknown or other
  misc_feature (775)..(775): n is a, c, g, or t
tcagcatagtagtgcacgaccggtgctcgatttagctagtcactcaagggaaagggtgtacacctgtggttctcggggctgccctttggctttggagatggttttctcggaaggggctggagtgggtctcaggtattagtggtagtggtgatggcacatactacgcagactccgtgaagggccgttcagcatctccagagacaattccaagaacacgttggattctgacaaatgaacagcctgagacgccgacgacgacggccgtaatattactgtcgagaaagatacggtagacacagtgtagtcggggtccggggcggggggactaaggtcggaccggttcggtacggggacccgaaacggggacccgtaaccgggtaccctaccccggttcctacccgtaccgaccgtcccctacccgaacccgaaccggggtcccctaacggttccccggttaccccctttaccccccggtcggtaccccctaccccccgttcccgtaacccgaaacggtccgtacccgtacccggttccgggtacgggggaccctaaccggtacccgggtccccgggtcccggtcgggtcccttccgggtacccggttaccgggttaccgtaaaccggttaccccgtttaacccctttaacccccgtaaccgttaccgttaacggttccggtaccggttacggggtaaccgggtacccgggtccggtaacgggaccggtaacgggtcccggtaacgtacgtacggctacgaccgtncgcagcgtacgatncgtgcgtg

SEQ ID NO: 150180 - DNA, 436 bp, Homo sapiens
  misc_feature: GYAE6OF02FGIA3.10.77.G11.1.454.CMB.1.raw
  modified_base (243)..(243): a, c, t, g, unknown or other
  misc_feature (243)..(243): n is a, c, g, or t
  modified_base (431)..(436): a, c, t, g, unknown or other
  misc_feature (431)..(436): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtcncggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttccactactatgctgagcgggctggcaaggcgcatagnnnnnn

SEQ ID NO: 150181 - DNA, 502 bp, Homo sapiens
  misc_feature: GYAE6OF02GE8G6.10.77.G11.1.454.CMB.1.raw
  modified_base (490)..(502): a, c, t, g, unknown or other
  misc_feature (490)..(502): n is a, c, g, or t
tcagcatagtagtgcacgaccggtgctcgatttagctagtcactcaagggaaagggtgtacacctgtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtctccccctggcaccctcctccaagagcacctctgggggcacagcggccctgggctgcctggtcaaggactacttcccactactatgctgagcgggctggcaaggcgcatagnnnnnnnnnnnnn

SEQ ID NO: 150182 - DNA, 440 bp, Homo sapiens
  misc_feature: GYAE6OF02FQWMQ.10.77.G11.1.454.CMB.1.raw
  modified_base (434)..(440): a, c, t, g, unknown or other
  misc_feature (434)..(440): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatgctgagcgggctggcaaggcgcatagnnnnnnn

SEQ ID NO: 150183 - DNA, 506 bp, Homo sapiens
  misc_feature: GYAE6OF02IZZIX.10.77.G11.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccaggggaaangccaccctctcctgcagggccagtcagagtcttagganctccttagcctggtatcaacagaaacctggccaggctcccaggctcctcatctatgatgcatccaacgagggccactggcactcccagccaggttcagtgcagtggtctgggacagacttcactctacaccatcagcagactagacgcctagaagtatttgactagtttattactgtcagcagcgtagctaacgtgacctcggacgttcggaccgaaggacaagtgacagtacgagacgaacgtgtcgctcgacacagtcgtgttc

SEQ ID NO: 150184 - DNA, 537 bp, Homo sapiens
  misc_feature: GYAE6OF02F9R1E.10.77.G11.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtctagganctccttagcctggtatcaacagaaacctggccaggctccaggctcctcatctatgatgcatccaacgacgggccacgtggccatcccagccaggtcaggtggcaggtgggtcgtgggacagacttcactctcacctatcagcagactagacgccgtagaagtatttgacttagttttacttacttgtcagcaggcgtacgacacgtcggccttcggtaccgttcgaccgaacgggacctaaggtcggacacgtacgaagtcgaactggtggactggaccacctnttcgtnttccg

SEQ ID NO: 150185 - DNA, 432 bp, Homo sapiens
  misc_feature: GYAE6OF02IG8CN.10.77.G11.1.454.CMB.1.raw
  modified_base (425)..(432): a, c, t, g, unknown or other
  misc_feature (425)..(432): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctcggggcacagcgccctggctgctggtcaaggctactccactactatgctgagcggctggcaggcgcatagnnnnnnnn

SEQ ID NO: 150186 - DNA, 573 bp, Homo sapiens
  misc_feature: GYAE6OF02FJ89V.10.77.G11.1.454.CMB.1.raw
  modified_base (232)..(232): a, c, t, g, unknown or other
  misc_feature (232)..(232): n is a, c, g, or t
  modified_base (516)..(516): a, c, t, g, unknown or other
  misc_feature (516)..(516): n is a, c, g, or t
  modified_base (520)..(521): a, c, t, g, unknown or other
  misc_feature (520)..(521): n is a, c, g, or t
  modified_base (523)..(527): a, c, t, g, unknown or other
  misc_feature (523)..(527): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattacctgtgcgaaagatacgtggacncatgtatgggtccgcgggggggtcaatggacgtcgtggggccagggaccacggtcaccgtctcctcacgcctccgaccaaggtccagtccggtccttcccccgtggccaccctccctccgaacggacgccgtacctcgtcgggggccacgacggccgggtcccctggggcctcggcccgttgggtaccaacgggtaccttaccgttccccaacgtttacctactcggtcctagggacggccggggtccgttcgggacctaaacggggcccgactaacgttacgncgcnncnnnnncacncncncncgcgcncngcgcncncnncncncncncncncncnnc

SEQ ID NO: 150187 - DNA, 610 bp, Homo sapiens
  misc_feature: GYAE6OF02IGSG5.10.77.G11.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
tcagcatagtagtgcacgaccggtgctcgatttagctagtcactcaagggaaagggggaggaactgctcagttaggacccagagggaaccatggaagccccagctcagcttctcttcctcctgctactctggctcccagattcccaccggagaagttgtgttgacacagtctccagccaccctgtctttgtctccaggggaaancgcccaccctntcctgcagggccagtcagagtcttagganctcttagcctggtatcaacagaaacctggccaggcctccgaggcctcctcatctatgatgactactccaacgacgggccacgtggaccactccccgagccgtaggttcaggtcggctagggttgggtctggggacacggtacttcactcctcacctatcagcaagactagacgtcgtagaacgttagttttcgacttaagtttttacttacgtgttacacgtcaacggtcgtacgacctaacgtccgggtaccctacgggtaaccgttccgggaaccgtaaacgggtaaccaaggtcggaactacgtacggaacgtacggtaacgttggtcggtacctggaccctaaccgtattccgtagtttacc

SEQ ID NO: 150188 - DNA, 812 bp, Homo sapiens
  misc_feature: GYAE6OF02II99J.10.77.G11.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagcatagtagtgcacgaccggtgctcgatttagctagtcactcaaggggaaagggggaggaactgctcagttaggacccagagggaaccatggaagccccagctcagcttctcttcctcctgctactctcggctccagattccaccggagaagttgtgttgacacagtctccacgcccaccctgttctttgtcctacgaaggggaaancgccaccctctcctgccngggaccagtcaggtgtacgttaggacgtccttaccgttacgcgttacggttatacctaaacaacggtaaaaccgtcggacccgtaagggccttcccgaacgggtcccttacccctactaacttacctaagttacgtaacgttcgacctaacgttacccgaaaaccggaccggggtcccctaacgttacgggaccctaacgttcccccaacggtacccgttaacgggtttccggaacgggttcgggacgtacgggttacgggggtccggtacggggaaacgtacggttaacccttccgtaacctaccggtacctaaccgtacgtaccgaacggacgtaaacggtaacgttacgtaaccggaccgttaaggtaacgttagtttacggtacgtttaaacgtttaatttacgtacggttacgagtacaacggtcggtaacgtacgacccggtttaggcccgttaacggggttaccggtcggtaacccggtaaaaccgggaaccgtaaacggaggtaaaccggtataacggaacgtacgtacggtacggtcgacgttaccggccttaacgacccgtttacgtcttacgg

SEQ ID NO: 150189 - DNA, 715 bp, Homo sapiens
  misc_feature: GYAE6OF02F08ZU.10.77.G11.1.454.CMB.1.raw
  modified_base (230)..(230): a, c, t, g, unknown or other
  misc_feature (230)..(230): n is a, c, g, or t
  modified_base (657)..(657): a, c, t, g, unknown or other
  misc_feature (657)..(657): n is a, c, g, or t
  modified_base (663)..(663): a, c, t, g, unknown or other
  misc_feature (663)..(663): n is a, c, g, or t
  modified_base (667)..(668): a, c, t, g, unknown or other
  misc_feature (667)..(668): n is a, c, g, or t
  modified_base (672)..(673): a, c, t, g, unknown or other
  misc_feature (672)..(673): n is a, c, g, or t
  modified_base (676)..(676): a, c, t, g, unknown or other
  misc_feature (676)..(676): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (696)..(697): a, c, t, g, unknown or other
  misc_feature (696)..(697): n is a, c, g, or t
  modified_base (699)..(699): a, c, t, g, unknown or other
  misc_feature (699)..(699): n is a, c, g, or t
  modified_base (701)..(701): a, c, t, g, unknown or other
  misc_feature (701)..(701): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
  modified_base (709)..(710): a, c, t, g, unknown or other
  misc_feature (709)..(710): n is a, c, g, or t
  modified_base (712)..(715): a, c, t, g, unknown or other
  misc_feature (712)..(715): n is a, c, g, or t
tcagcatagtagtgcacgaccggtgctcgatttagctagtcactcaagggaaaggggctggagtgggtctcaggtattagtggtagtggtgatggcacatactacgcagacctccgtgaagggccggttcagcatctccagagacaattccaagaacacgttaggatctgacaaatgaacagcctgagagccgacgacacggccgtatattactgtgacgaaagatacgnggacacatgtagtcgggtccgggacggggggggacaacgggtacggtacggtacggggtaccgggaacgggaaccggaccggtaccggacccgtaccgtcccgttaccgtacggacccgtaccccaaccccggaaccgggaccccgtaccgtacccgggttccccgtttacccccgttacccggtcccgacccccgttacccctaacccgaaccgtaaccggccgtaaccccgttacccgtaccgggggtaccggaccgaaccggtccgggtaccccggtcggggtaccgtcgtcccggtacgggtacgtaaaccgggtaaccgttaacccttacccgtaccgttaaccgttacgttaccgacgtacggtacggacccggggcgtaccgggtaaccggaacgacccgggtcgaaaccgttagaccgnaaccgntacnncgannacncgacgacnagngnacagagnnanancannanannannnn

SEQ ID NO: 150190 - DNA, 445 bp, Homo sapiens
  misc_feature: GYAE6OF01COK88.37.80.H03.1.454.CMB.1.raw
  modified_base (438)..(445): a, c, t, g, unknown or other
  misc_feature (438)..(445): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctactatttttggactacttttactactacatggacgtctggggcaaaggggaccaaggtcaccgtctcctcagcctccaccaagggcccatcggtccttccccctcggccaccctcctccaagagcacctctggggcacgagcggcctgggctgctggtcaaggactacttccatctacactactgagcgggctggcaaggcgcatagnnnnnnnn

SEQ ID NO: 150191 - DNA, 567 bp, Homo sapiens
  misc_feature: GYAE6OF01B4FOO.37.80.H03.1.454.CMB.1.raw
  modified_base (364)..(364): a, c, t, g, unknown or other
  misc_feature (364)..(364): n is a, c, g, or t
  modified_base (544)..(544): a, c, t, g, unknown or other
  misc_feature (544)..(544): n is a, c, g, or t
tcagtagtgtagatcacgaccggtgctcgatttagctgtgcgtcgaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaaagcaaagatggaagtgaagaaatactatgtggactctgtgaagggccgaattcaccatctccagagacaacgcccaagaactcattgatctgacaaatgaaacagactgagagccgaggacacggctgtntattactgtgacgagagaggaggcgtattagtagtaaatggcgtgggcttctactactactactacatgacgtcgtagggacgaaacgggacgacgtacgaccgtctcctcacgccctaccaccgaacggcccgacgtccggtcccttccccgtgccctccctaccctaccgaacgaccnccacccgtcggtcggggcaccgg

SEQ ID NO: 150192 - DNA, 544 bp, Homo sapiens
  misc_feature: GYAE6OF01C7J1N.37.80.H03.1.454.CMB.1.raw
  modified_base (208)..(208): a, c, t, g, unknown or other
  misc_feature (208)..(208): n is a, c, g, or t
  modified_base (521)..(544): a, c, t, g, unknown or other
  misc_feature (521)..(544): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggaccacggccgcgtattacngtgcgaggagggtcggtcggggtctacgtatttttggactacttttacactacatggacgtcgtggggacaaaggggaccaaggtcaccgtctcctcagccctccaccaagggcccatcggtccttccccctggccacccctccctacccaacgacgccaacccttcgtacggggggccaaccgaggcccgggccccttggggcctcggcccgtgggtacccgaaagggacccttaccttcccaacttccctaacctacctaacgttggaacgggtccggggcgtcgggaccgaagggccgaccagtaagcgnnnnnnnnnnnnnnnnnnnnnnnn

SEQ ID NO: 150193 - DNA, 441 bp, Homo sapiens
  misc_feature: GYAE6OF01AYVUK.37.80.H03.1.454.CMB.1.raw
  modified_base (432)..(441): a, c, t, g, unknown or other
  misc_feature (432)..(441): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgattttggacacttttactactacatggacgtctggggcaaaagggaccaaggtcaccgtctcctcagcctccaccaagggcccatcggtcttccccctggcaccctcctccaagagcacctctggggcacagcggccctgggctgcctggtcaaggctactccatctacactactgagcgggctggcaaggcgcatagnnnnnnnnnn

SEQ ID NO: 150194 - DNA, 444 bp, Homo sapiens
  misc_feature: GYAE6OF01DCXQ3.37.80.H03.1.454.CMB.1.raw
  modified_base (434)..(434): a, c, t, g, unknown or other
  misc_feature (434)..(434): n is a, c, g, or t
  modified_base (436)..(444): a, c, t, g, unknown or other
  misc_feature (436)..(444): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggactacttttactactacatggacgtcgtggggacaaagggaccaaggtcaccgtctcctcagcctcaccaaggccatcggtcttccccctggccaccctcctccaagagcacctctggggcacagccgcctggctgcctggtcaaggactactcatcacactactgacgcgggctggcaacggcgacactagnannnnnnnnn

SEQ ID NO: 150195 - DNA, 432 bp, Homo sapiens
  misc_feature: GYAE6OF01BCTZJ.37.80.H03.1.454.CMB.1.raw
  modified_base (421)..(432): a, c, t, g, unknown or other
  misc_feature (421)..(432): n is a, c, g, or t
tcagtagtgtagatcacgaccggtgctcgatttagctgtgcgtcgaagggaagggactggagtggattgggcgtgtctatagtagtggcagtaccgactacaacccctccctcaagagtcgagtcaccatatcagtagacacgtccaagaaccagttctccctgaagctgagctctgtgaccgctgcggacacggccgtatattactgtgcgagaaaccaaccttctactactacatggacgtctggggcaagggggccacggtcaccgtctcctcacgcctccaccaagggcccatccggtcttccccctggccaccctcctccaagacgcacctcgtggggcacacgcgccgtggctcgcctggcaaggactacgtccactctacactactgacggcggctcggacaaggcgacatagnnnnnnnnnnnn

SEQ ID NO: 150196 - DNA, 381 bp, Homo sapiens
  misc_feature: GYAE6OF01DDY9P.37.80.H03.1.454.CMB.1.raw
  modified_base (215)..(215): a, c, t, g, unknown or other
  misc_feature (215)..(215): n is a, c, g, or t
  modified_base (366)..(381): a, c, t, g, unknown or other
  misc_feature (366)..(381): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagnggtcggtcggggtctacgtatttttggactacttttaacactacatggacgtcgtggggacaaaaggggaccaaaggtccaaccgtctcctcagccctccaccgaagggcccatccggtccttcccccgtggcctacccctcctaccgaannnnnnnnnnnnnnnn

SEQ ID NO: 150197 - DNA, 765 bp, Homo sapiens
  misc_feature: GYAE6OF01CW0ZX.37.80.H03.1.454.CMB.1.raw
tcagtagtgtagatcacgaccggtgctcgatttagctgtgcgtcgaagggaaaggggaagactgaccggtccccccaggagttcaggtgctgggcacggtgggcatgtgtgtagttttgtcacaagtatttgggctcaactctcctgtgcagcctctgtattcctacctttaatacctattggatgtaggttcggtccgtccgtaggttccgaaggggaagggcgtgggaggtgggtcggaccaaagaagtaaaagacgaaagagtaggaagtagaagaaatactagtggtaggactcgtggtaggaacggtcctattaccacctactaccgaccgagaacgtaaccgaacccgacccaagtaacctctagtttagtactcgtagtaacaaaagtacgaaacagtacgaggacgaacgtaccggaacgtacgacggtctagtagtttatacgtaggcgacgaggaacgaggagacgttaagtagtaagtaagtgtcgtacggtccttacgtaactaacgtactaacgtactacgtacggtacgtcggtaacgggaacggaaacccgggtacccgtaaccggtaccccgtaccggtacccctacccgtaccgaccgtaacccccgtaccgaaaccccggaccggtaccccgtaccggtttaccccgggtcccccgtttaccccggcgggtacccccctcccggtaccgtaccctacccgggaaccggtacccaccccgtaaccccggacggcccggtaaaccccgg

SEQ ID NO: 150198 - DNA, 498 bp, Homo sapiens
  misc_feature: GYAE6OF01DXXV2.37.80.H03.1.454.CMB.1.raw
  modified_base (463)..(464): a, c, t, g, unknown or other
  misc_feature (463)..(464): n is a, c, g, or t
  modified_base (467)..(498): a, c, t, g, unknown or other
  misc_feature (467)..(498): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgtatttttggactacttttactactacatggacgtcgtggggacaagggaccaaggtcaccgtctcctcacgcctccaccaacgggcccatcggttccttccccctcggccaccctcctccaagcgcacctcgtgggggccacacgccggccctcgggctggcctggacgaaggtactaccttccatcctacactacgtgacggcgggctggacgaacggcgacgataagnngannnnnnnnnnnnnnnnnnnnnnnnnnnnnnnn

SEQ ID NO: 150199 - DNA, 528 bp, Homo sapiens
  misc_feature: GYAE6OF01A5RZM.37.80.H03.1.454.CMB.1.raw
  modified_base (474)..(474): a, c, t, g, unknown or other
  misc_feature (474)..(474): n is a, c, g, or t
  modified_base (509)..(528): a, c, t, g, unknown or other
  misc_feature (509)..(528): n is a, c, g, or t
tcagtagtgtagatcacgaccggtgctcgatttagctgtgcgtcgaagggaagggactggagtggattgggcgtgtctatagtagtggcagtaccgactacaacccctcccctcaagggtcgagtcaccatgtcagtagacacgtccaagaatcagttttccctgaaggtgacctctgtgaccgccgcggacaccggccgcgtattactgtgcgagagggtcggtcggggtctacgtattttggactacttttactactacatggacgtcgtggggacaaacggggaccaaggtcaccgtcctcctcacgcctccaccgaacgggcccctagtcccggttccccttccccccgtcggccctaccccgtccctacccaacgacgcctacccgtcggtggggccacgacgccggcccgtggggcctggccgtcgggtacgaacggtacctaccgttccacgttacactacgtacgnggacggcgggcgtacggacgaacggccgagaatgnnnnnnnnnnnnnnnnnnnn

SEQ ID NO: 150200 - DNA, 653 bp, Homo sapiens
  misc_feature: GYAE6OF01DKHYP.37.80.H03.1.454.CMB.1.raw
  modified_base (157)..(157): a, c, t, g, unknown or other
  misc_feature (157)..(157): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
tcagtagtgtagatcacgaccggtgctcgatttagctgtgcgtcgaagggaagggactggagtggattgggtcgtgtctatagtagtggacagtaccgactacaacctcctcaaggtcgatcacatgcagtagacacgtccaagaatcagttttccngagtacgacgtgtgtacgccgcgcgacgaccggcacgtattacgtgtcgcgaggtacggtcggtcggtacttaggtacttttggaactacgtttactaacgtacagttggacgttacgacggggtaacaaagggaacctaaggtcctaaccgtccgtaccgtaccgtaacgtccctaaccgaacccgtaacgggaccctaacggttccgttccctttaaccccgtacgaccccgtacccttacccgcgtaaacgcgtaccaccgtacggtcgggacacgacggcgtaccgnggtcncgtccgtacggtacaacggtaactaccgttacgactacgtaacacgttagtacgacggtcggacgtagacgtaacgcganagtancgtancgtacatagacaganagacgaanagacgagagacgagtagtagtacacgacgtacgtagacgacgcgtacgtagagtcgaacgacacgtacaacaataagtacgtagacg

SEQ ID NO: 150201 - DNA, 439 bp, Homo sapiens
  misc_feature: GYAE6OF02ISQH1.37.80.H03.1.454.CMB.1.raw
  modified_base (434)..(439): a, c, t, g, unknown or other
  misc_feature (434)..(439): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggacacttttactactacatggacgtctggggcaaagggaccaaggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnnnnnn

SEQ ID NO: 150202 - DNA, 440 bp, Homo sapiens
  misc_feature: GYAE6OF02HVIBH.37.80.H03.1.454.CMB.1.raw
  modified_base (432)..(440): a, c, t, g, unknown or other
  misc_feature (432)..(440): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggactacttttactactacatggacgtctggggcaaagggaccaaggtcacgtctcctcagcctcaccaaggcccatcggtcttccccctggccaccctcctccaagacgcaccctctgggggcacgagcggccctgggctgcctggcaaggctactcatctacactactgagcggctggcaaggcgcatagnnnnnnnnn

SEQ ID NO: 150203 - DNA, 483 bp, Homo sapiens
  misc_feature: GYAE6OF02HM2CT.37.80.H03.1.454.CMB.1.raw
  modified_base (337)..(337): a, c, t, g, unknown or other
  misc_feature (337)..(337): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (469)..(470): a, c, t, g, unknown or other
  misc_feature (469)..(470): n is a, c, g, or t
  modified_base (472)..(483): a, c, t, g, unknown or other
  misc_feature (472)..(483): n is a, c, g, or t
tcagtagtgtagatcacgaccggtgctcgatttagctgtgcgtcgaagggaagggacgtggagtggagttgggcgtgtctatagtagtggcagtaccgactacaaccctccctcaacgggtcgagtcaccatgtcagtagacacgtccaagaatcagtttccctagaaggtgacctctgtgaccgccgcggaccacggccgtcgtattactgtgcgagagttcggcccatacgtaccagctgtctcgcatcgcttttgatatcgtggggcccaaagggacaagtggtacaccgtctcgttcagccctcaccgaaggccccatccggtccttccccgngcacccccgtcctccgaaagcaccacctgacggggcacacgccggcctgggctcgccttggtcaaaggctaccgtcactactacactacctggagtccggggctagggctaacgggcgacttanagcgntanncnnnnnnnnnnnn

SEQ ID NO: 150204 - DNA, 449 bp, Homo sapiens
  misc_feature: GYAE6OF02IVYUH.37.80.H03.1.454.CMB.1.raw
  modified_base (442)..(449): a, c, t, g, unknown or other
  misc_feature (442)..(449): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggacacttttactactacatggacgtctggggcaaagggccaaggtcaccgtctcctcagcctccaccaagggcccatcggtcttccccctggccacccctcctccaagagccacctctgggggcacgagcggccctgggcctgccgtggtcaaggactacttccatctacactactgacgcgggctggcgaaggcgcatagnnnnnnnn

SEQ ID NO: 150205 - DNA, 445 bp, Homo sapiens
  misc_feature: GYAE6OF02GXNV7.37.80.H03.1.454.CMB.1.raw
  modified_base (436)..(445): a, c, t, g, unknown or other
  misc_feature (436)..(445): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggacacttttactactacatggacgtctggggcaaagggaccaaggtcaccgtctcctcagcctccaccaagggcccatcggtcttccccctggcaccctcctccaagacgcacctctgggggcacagccggcctgggctgcctggtcaaggactacttccatctacactactgagcgggctggcaaggcgcatagnnnnnnnnnn

SEQ ID NO: 150206 - DNA, 442 bp, Homo sapiens
  misc_feature: GYAE6OF02F4JKZ.37.80.H03.1.454.CMB.1.raw
  modified_base (433)..(442): a, c, t, g, unknown or other
  misc_feature (433)..(442): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcgggtctacgattttggacactttactctacatggacgtctggggcaaagggccaaggtcaccgtctcctcagcctccaccaagggccccatcgtcttccccctggcacctctccaagagcaccctctgggggtcacagcggcccctggggctgccctggtcaaggactacttccatctacactactgagcgggctggcaaggcgcatagnnnnnnnnnn

SEQ ID NO: 150207 - DNA, 456 bp, Homo sapiens
  misc_feature: GYAE6OF02HOHGB.37.80.H03.1.454.CMB.1.raw
  modified_base (446)..(456): a, c, t, g, unknown or other
  misc_feature (446)..(456): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcggtcggggtctacgtatttttggactacttttactactacatggacgtctggggcaaagggaccaaggtccaccgtctcctcagcctccaccaaggcccatccggtccttcccctggccacccctcctccaagacgcacctctggggcacgacgcggccctgggctcgccgtggtcaaggactacgtccatctacactactgacgcggctggacaaggcacagtagnnnnnnnnnnn

SEQ ID NO: 150208 - DNA, 573 bp, Homo sapiens
  misc_feature: GYAE6OF02FZEMK.37.80.H03.1.454.CMB.1.raw
tcagtagtgtagatcacgaccggtgctcgatttagctgtgcgtcgaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccaagaactcattgtatctgacaaatgaacagactgagagccgaggacacggctgtgtattacgtgtgacgagaggaggaggcgtaagttaggtagtaaagtggtacgtgggtccttactactactactactaactagtcggacgtcgtgggacgaacgggaccgacggtcgaccgtctccgtcacgccctccaaccgacggccctacgtccgtccgtccccgtcgcccaccctcctaccgacgacgacctaccgtcgtcgggctaccgg

SEQ ID NO: 150209 - DNA, 582 bp, Homo sapiens
  misc_feature: GYAE6OF02G6KAL.37.80.H03.1.454.CMB.1.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (541)..(542): a, c, t, g, unknown or other
  misc_feature (541)..(542): n is a, c, g, or t
  modified_base (544)..(546): a, c, t, g, unknown or other
  misc_feature (544)..(546): n is a, c, g, or t
  modified_base (551)..(582): a, c, t, g, unknown or other
  misc_feature (551)..(582): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtcgaccgccgcggacacggccgtcgtattactgtgcgaggaggtcggtcgggtactacgtagtttttggactactttactactacatggacgtgtgggacaaaggaccaaggtcaccgtctccgtcacgccctcccaacgaaccgggccctaacttcggttccccttccccgtggtccccacccctccctaccaacggacnccctaccgttccggnggggggaccacgacggtcccggcccgtcgggaccgtcgcccggtttaggtaacccaagggtaacccttaccgttccgtaacttcttaacccgaacttaccgtggaccgggtcgggctcgggaaccgaagggcccgagtaacgtagcgnngnnngcgcnnnnnnnnnnnnnnnnnnnnnnnnnnnnnnnn

SEQ ID NO: 150210 - DNA, 518 bp, Homo sapiens
  misc_feature: GYAE6OF02GLVL9.37.80.H03.1.454.CMB.1.raw
  modified_base (259)..(259): a, c, t, g, unknown or other
  misc_feature (259)..(259): n is a, c, g, or t
  modified_base (467)..(467): a, c, t, g, unknown or other
  misc_feature (467)..(467): n is a, c, g, or t
  modified_base (500)..(518): a, c, t, g, unknown or other
  misc_feature (500)..(518): n is a, c, g, or t
tcagtagtgtagatcacgaccggtgctcgatttagctgtgcgtcgaagggaagggactggagtggattgggcgtgtctatagtagtggcagtaccgactacaacccctccctcaagggtcgagtcaccatgtcagtagacacgtccaagaatcagttttccctgaaggtgacctctgtgaccgccgcggacacggccgcgtattactgtgcgagaggtcgggtcgggtctacgtattttggactacttttactactacntggacgtgtggggacaaagggaccaaggtcaccgtctcctcacgcctcccaccgaacggcccagtccggtcccttccccccgtggtcccctaaccccgtccctacccgaagacgccctaccgtcggtcgggggaccacgacggcccggccgtgggcctcggcccgtggtacgtaagtacgtttaccttccacttcctaacacttacgngaggcgggtcgtcggacgtaagggcagatacgnnnnnnnnnnnnnnnnnnn

SEQ ID NO: 150211 - DNA, 1037 bp, Homo sapiens
  misc_feature: GYAE6OF02IS5C1.37.80.H03.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (349)..(349): a, c, t, g, unknown or other
  misc_feature (349)..(349): n is a, c, g, or t
tcagtagtgtagatcacgaccggtgctcgatttagctgtgcgtcgaagggaaaggggaagactgacggtccccccaggagttcaggtgctgggcacggtgggcattgtgtcgtagttttgtcacaagacttttgggcttcaactctcctgtncagcctcnggtattctacctttaatacctattggatggtacgtttcgggtccgcctacgggttccgaaggggtaacgggcttagggaggtacgggtcgaccaaactagtaaaagacaaagacgttaggaagtaggaaataaacttactagttggtacgacttcgtcgtaggaaacggggtcctacttaccaaccgtnttcccgtaccaaggaccgaaccgaaaccccgacccgtaaggtaaaccttcggtaattttacggttaacttcgtaacgaaccttaaaaaggttccgaaaacccggaaggttacccttaagggaaacgggtaaccccggacggggtaaacggtaaccccgttacggggttaccctttaggggtaacctttttaacggtttaacggttacgggtacggtaacggggtaaacggaaaccgggggtaaggggttaaccggtaaggtttaaaaggttttaacgggttaaggtttaaaacgggtccgggttacccgggtttcgggttaacccgttttacccgttaaaccgttaacccgtttaaccgttaaacttaacccggttaaggttaccggggtttaaccggtccggggttaacggggtaaacccgggaaacgggttacccggaccggttaacccgttacccgttacccgttacctacccggtaacccgttccccgtaaacccgtacccggttaaacccgggttcccacccgggttttacccccggttaccccccggtttttacccccggaccccggtttaaacccccgtaacccccgtttaaccccggtaaaccccgtttaacccggggaccttcccccggttaacccgggttaccccgggggttccggggtaaaccccttaacccggggg

SEQ ID NO: 150212 - DNA, 313 bp, Homo sapiens
  misc_feature: GYAE6OF01E3I1W.15.6.A06.1.454.CMB.1.raw
  modified_base (299)..(313): a, c, t, g, unknown or other
  misc_feature (299)..(313): n is a, c, g, or t
tcagtctacgtagccacgaccggtgctcgatttagatctactgacaacacgacaagggggacgggatccctgatcgcttctcaggctccagttctggggctgagcgcaccctcgtcatctccagcctccagtctgaggatgagggtgactattattgtcagacgtggggcagtggcgttcaggcagttcggcggagggaccaagctgactgtcctcggtcagcccaaggctgccccctggtcactctgttcccaccctcctcgctacgtagacctgagcgggctggcaaggcgcatagnnnnnnnnnnnnnnn

SEQ ID NO: 150213 - DNA, 306 bp, Homo sapiens
  misc_feature: GYAE6OF01DMA32.15.6.A06.1.454.CMB.1.raw
  modified_base (298)..(306): a, c, t, g, unknown or other
  misc_feature (298)..(306): n is a, c, g, or t
tcagtctacgtagccacgaccggtgctcgatttagatctactgacaacacacgaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctggtcagcccaaggctcgcccctggtcactctgttcccgcctcctcgctacgtagactggacgcgggctggcaaggcgtcatagnnnnnnnnn

SEQ ID NO: 150214 - DNA, 542 bp, Homo sapiens
  misc_feature: GYAE6OF01DV57J.43.57.F02.1.454.CMB.1.raw
  modified_base (393)..(393): a, c, t, g, unknown or other
  misc_feature (393)..(393): n is a, c, g, or t
tcagtgtgagtagtcacgaccggtgctcgatttagctcgatatagttgggtttggggctgagcgtggcgttttctaggtggctaattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaaacagcctgagagccgaagacacggccgtatatttacngtgcgagaggcgtcggagagtacgatattttgactggttatttgcgctactactactacgctttggacgtctggggccaagggaccacggtcaccgtctcctcacgcctccaccagggcccatccggtcttccccctggccgccctgcc

SEQ ID NO: 150215 - DNA, 631 bp, Homo sapiens
  misc_feature: GYAE6OF01BLH6Q.43.57.F02.1.454.CMB.1.raw
  modified_base (611)..(611): a, c, t, g, unknown or other
  misc_feature (611)..(611): n is a, c, g, or t
tcagtgtgagtagtcacgaccggtgctcgatttagctcgatatagttgggtttgggggctgagcgtgcgttttctaggtggctattttaaaaggtgtccagtctgaggagcagctgttggagtctgggggaggcttgatacaggccgggggggtccctgagactctcctgtgtagcctctggacttcacctttaacaactatgccatgacctgggtccgccaggctccagggaaggggctggagtgggtctcagtaataagtggaagtgctggtaccacacttttatgcagactccgtgagtcggggccgttcaccatcctccaaggacgacaaacttcccaaagaaccacgctgtgtctgacaaatcgaacagcctagagacgaccgaagaccgtacggccgttaatattaccgttgcgacgtaggacggcggtcggagtacgtacgatttaagttttggacttgggtttattgccgtctaacttactacgttacgtcgtttaggaccgttcgtcggggaccaacggggtccacgggtcctaccgtctccctccgacgtccctacccgtaaccggaccggcccctacgttcccgggttcccttcccccgnggcccgtcccctggtccccg

SEQ ID NO: 150216 - DNA, 620 bp, Homo sapiens
  misc_feature: GYAE6OF01A3JQM.43.57.F02.1.454.CMB.1.raw
  modified_base (286)..(286): a, c, t, g, unknown or other
  misc_feature (286)..(286): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagtgtgagtagtcacgaccggtgctcgatttagctcgatatagttgggtttgggggctgagcgtgcgttttctagtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgagggaaggggctggagtgggtctcagtaataagtggaagtgctggtaccactactttangcagactccgtgatcgggccgttcaccatcctccaggacacaacttccaaagaacacgtctgtgtctgacaaatcgaactagcctgagacgccgaagacgacggtacctatattactggtancgtagnggcgtcggagagtaacgtattagtttgacttggtttacttgcgtactacttactacttacgtctttgggactcggtcggggaccaagggaccgtaccggtcacccggttctacccgtcgaaccgtcccgttaccacccggtaaacgggcccctacgttccccgggttaccctttccccccggagggtccctccccgtggtaccccg

SEQ ID NO: 150217 - DNA, 528 bp, Homo sapiens
  misc_feature: GYAE6OF01BHFMX.43.57.F02.1.454.CMB.1.raw
  modified_base (525)..(525): a, c, t, g, unknown or other
  misc_feature (525)..(525): n is a, c, g, or t
tcagtgtgagtagtcacgaccggtgctcgatttagctcgatatagttgggtttgggggaggcttgatacagccggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtatattactgtgcgagaggcgtcggagagtacgatatttgactggttattgcgctactactactacgctttggacgtctggggccaagggaccacggtcaccgtctcctcagcctccaccaaggcccatcgtcttcccctgccgcctcgctccaggacgcacctccgacgagcacacgcggccctgggctcggcctggtcaaggctacttccactcncac

SEQ ID NO: 150218 - DNA, 594 bp, Homo sapiens
  misc_feature: GYAE6OF01BJG5Q.43.57.F02.1.454.CMB.1.raw
  modified_base (192)..(192): a, c, t, g, unknown or other
  misc_feature (192)..(192): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (574)..(574): a, c, t, g, unknown or other
  misc_feature (574)..(574): n is a, c, g, or t
tcagtgtgagtagtcacgaccggtgctcgatttagctcgatatagttgggtttgggggctgagctggcttttccttgtggctattttaaaaggtgtccagtctgaggagcagctgttggagtctgggggaggcttgatacagccggggggtccctgagactctcctgtgtagcctctggattcacctttaanaactatgccatgacctgggtccgccaggctccgagggaaggggctggagtgggtctcagtaataagtggaagtgctggtaccacactttangcagactccgtgagtgggccggttcaccatctccagacgacaattccaagaacagctgtgtctgacaaatgaacngcctgagngaccgaanaccacggccgtatacttactggtgacgagaggcggtcggagagtacgattagtttgacttggttatttgcgtactactactactacgtcgttaggtacgtcgtggggaccgtaacgggccctacggtaccgtaccgtcctcctaccgacgccctacccgaacccggtaacgggcccctagtccgggttcccttcccccgnggcccgtcccgtcgtacccg

SEQ ID NO: 150219 - DNA, 559 bp, Homo sapiens
  misc_feature: GYAE6OF01ES0PO.43.57.F02.1.454.CMB.1.raw
  modified_base (543)..(543): a, c, t, g, unknown or other
  misc_feature (543)..(543): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgacaaatgaacagcctgagagaccgaagacacggccgtaatattactgtgcgagaggcgtcggagagtacgatatttgacttggttatttgcgtctactactactacgtctttcggacgtcgtcggggaccaacgggaccgacggtccgaccgtctcctcacgccctccaccacggcccatccggtccttcccccgnggccctcccgtgcccg

SEQ ID NO: 150220 - DNA, 712 bp, Homo sapiens
  misc_feature: GYAE6OF01DEPT8.43.57.F02.1.454.CMB.1.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggcccgggggggtccctgagactctcctgtgtagcctctggattcacctttaacaactatgccatgacctgggtccgccaggctccgaggggaaggggctggagtgggtctcagtaataagtggaagtgctggtaccanactttangcagactccgtgagtgggccgttcaccatcncagagacaattccggaaanaacacgtctgtgtcngacaaatgaaacngcctaggagacgacccgaaagtaccaccgggtaccttaattaactttacgtggtgaccggtaagggacgggtaccgggtacgggaaggtaacggttacgtaattttaagtttttacggtacgtttaggttttaagtttcgaccgtacctttaaactaccttaaccgttacggttccgtttacgggaaccggttccggtagggggacccgtaaacggggaccctaccgggtacctaccccgttcctccccgtcaccggtacccctacccgaaccccggaaacgggtccccctaagttccccggtttaccccttacccccgagttcccgggcccgtccccgttaccgg

SEQ ID NO: 150221 - DNA, 555 bp, Homo sapiens
  misc_feature: GYAE6OF01BMWJW.43.57.F02.1.454.CMB.1.raw
  modified_base (539)..(539): a, c, t, g, unknown or other
  misc_feature (539)..(539): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtaatattactgtgcgagaggcgtcggagagtaacgattatttgacttggttattgcgtctactactactacgtcttggacgtcgtggggccaacgggaccgacggtcaccgtctcctcacgccctccaccgacggcccagtccggtccttcccccgnggccgcccgtgtcccg

SEQ ID NO: 150222 - DNA, 584 bp, Homo sapiens
  misc_feature: GYAE6OF01DRCDO.43.57.F02.1.454.CMB.1.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (515)..(515): a, c, t, g, unknown or other
  misc_feature (515)..(515): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
tcagtgtgagtagtcacgaccggtgctcgatttagctcgatatagttgggtttggggggctgagctggtcttttcttgtggctaattttaaaaggtgtccagtctgaggagcagctgttggagtcgtgggggaggcttgatacagggcccggggggtccctgagactctcctgtgtagcctctggattcaacctttaacaacttatgccatcgaccgtgggtcccgccaggcctaccgaggggaaggggctggagtgggtctcagtaataaggtggaagtgctggtaccactacttttangcagactcgtgagtcgggccgttcacatcctcagagacaatccaaagacacgtntgtnctgacaaatgaaacngctgaagacgaccgaanacgcgtactatattcngtcgcgaggaggcgtaggagtagtacgtattagtttgagttgttattgctactactactctacgtcttggacgtcgtcgggacgaacgaccacgtcctaccgtctcccncgacgcccctacgaaccgacgggcccctagttcccggtaccccttccccgnggtcccncccgtgacccg

SEQ ID NO: 150223 - DNA, 742 bp, Homo sapiens
  misc_feature: GYAE6OF01C0RX5.43.57.F02.1.454.CMB.1.raw
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (712)..(712): a, c, t, g, unknown or other
  misc_feature (712)..(712): n is a, c, g, or t
tcagtgtgagtagtcacgaccggtgctcgatttagctcgatatagttggggtttgggggggctgagctggctttttcttgtggctattttaaaaggtgtccagtctgaggagcagctgttggagtcgtgggggaggcttgatacaggcccgggggggtccctgagactctcctgtgtagcctctggattcacctttaacaactatgccatcgacctggggtccgccaggctccgaggggaaggggctgggagtgggtctcagtaataagtggaagtgctggtaaccacactttangcagactccgtgagtcgggcccgttcaccatcctacagagacaattccaaagacacgctgtgtactgactaaatgaaacngcctaggacgaacggaccgaaagaccgacggccgttaatacgtttaactggtgacggaggacgggcggtacgggaagaaggtaacgtaatttaagttttacgtacgtttaggtttaacgttttgccggtacctttaacctaacctttaaccgttacggttacgttttacgggaaccggtttcggttcgggggaacccgtaaacgggggtaaccccgtaccggggttaccctaaccccggttcctaccccgttaccgaccgtcccccgtaaccccgtaacccgggaaacccgggtccccctaacggtttcccccgggttaccccgtttcccccccggnggtacccccggtccccgtcggtacccccgg

SEQ ID NO: 150224 - DNA, 560 bp, Homo sapiens
  misc_feature: GYAE6OF01B0T0F.43.57.F02.1.454.CMB.1.raw
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaaggggctggagtgggtctcagtaataagtggaagtgctggtaccacacttttangcagactccgtgatgggccgttcaccatctccagagacaattccaagacacgctgtgtctgacaaatgaaacngctagagacgccgaagacncggcctaatattacgtgtgcgaggacggcgtcggagagtacgattatttgacttggttattgctctactactactacgtcgtttggacgtcgtggggacctaagggcctacggtcacccgtctcctcacgcctaccaccgacggcccagttccggtccttcccccgtggcctcccgtgcccg

SEQ ID NO: 150225 - DNA, 589 bp, Homo sapiens
  misc_feature: GYAE6OF01DL0AF.43.57.F02.1.454.CMB.1.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
tcagtgtgagtagtcacgaccggtgctcgatttagctcgatatagttgggtttgggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggcctccgaggggaaggggctgggaggtgggtctcagtaataaggtggaagtgctggtaaccacactttangcagacctccgtgagtgggccgttcacatctccagagacaatccaagaacacgctgtntctgacaaatgaaacngcctgagagaccgaagacgacggccgtaatattactgtgcgagaggcgtggagagtacgattagtttgacttggttattgcgtctactactactacgtcgttcggtacgtcgtcgggaccgaacgggaccaccggtccacccgtcctcccgtcgacgccctacccaacccgaaccgggcccctagtcccggttcccttcccccgtggcccgccccgtgcccg

SEQ ID NO: 150226 - DNA, 650 bp, Homo sapiens
  misc_feature: GYAE6OF01BMNTL.43.57.F02.1.454.CMB.1.raw
  modified_base (99)..(99): a, c, t, g, unknown or other
  misc_feature (99)..(99): n is a, c, g, or t
  modified_base (182)..(182): a, c, t, g, unknown or other
  misc_feature (182)..(182): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagtgtgagtagtcacgaccggtgctcgatttagctcgatatagttgggtttggggggctgagcgtggtcgttttctaggtggctaattttaaaaggngtccagtctgaggagcagctgttggagtcgtgggggaggcttgatacgaggccggggggtcctgagctctcctgtgtagcctntggattcaacctttaacaactatgccatcgaccgttgggccgccagggccacgaggggaagggctggagtgggtctgaagtaataaggtggaagtgcgtagtaccactatttangcagacctcgtagngtcggggccttnacctatccacagacacattaccaagaacncgtntgtctacganaactaagacgaacgacgcgagacgacgaacgtaagacgtacgtacttatacgttcgngacgacggaggnggtacggtacggaagtacgtacgttagtttagtttacgtacgtttagtttagtcgtacttacttactacgttacgtacgttcgttacggcggtcgggacggacggaacggtaccgtaccgtccgtaccgtccgtcctacgtaccgtcccgtaccgaaccggtccgacccgttacggttccccgttccccgtcccggtccggccctccgtcgtcccg

SEQ ID NO: 150227 - DNA, 662 bp, Homo sapiens
  misc_feature: GYAE6OF01A2FED.43.57.F02.1.454.CMB.1.raw
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagtgtgagtagtcacgaccggtgctcgatttagctcgatatagttgggtttggggggctgagcgtgtcgtttctaggtggctattttaaaaggtgtccagtctgaggagcagctgttggagtctgggggagcttgatacaggccgggggggtccctgagactctcctgtgtagcctctggattcacctttaacaactatgccatgacctgggtccgccaggctccgagggaaggggctggagtgggtctcagtaatagtggaagtgactggtaccacacttttancgacagtactccgtgatggggccgttcacctatctacagacgacaattccaagaacacgctgtntctgacaaatcgaacagctganacggaccgaagaccacggccgttaataacttacgtggtacgacgaaggacggtcggtacggaacgtaagtaacgtaagtttagttttacgacgtttggttttaacttcgtacgtccttaacttaccgttaacttaaccggttcgttttacgggacggttacggtacgggggtaaccaaacgggacccgtaacggtcccgaacccgttcctacccgtcgaacccggtccctacccgtaaccggacggccctacggtcccgttcccttccccgtggcccctccgtgtcccg

SEQ ID NO: 150228 - DNA, 567 bp, Homo sapiens
  misc_feature: GYAE6OF01DC1ZX.43.57.F02.1.454.CMB.1.raw
  modified_base (284)..(284): a, c, t, g, unknown or other
  misc_feature (284)..(284): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttangcagactccgtgatgggctggttcaccatctccagagacaattccaagaacacgctgtgtctgacaaatgaaacagcctgagacgccgaagacacggccgtatattactgtgcgagaggcgtcggagagtaacgtatatttgacttggttattgcgtctactactactacgtctttggacgtcgtcgggccgaagggaccacggtccaccgtcctcctcgcgccctccacccgaacgggccctacgtcccggttcccttccccccgtcggcccgtcccgtccg

SEQ ID NO: 150229 - DNA, 617 bp, Homo sapiens
  misc_feature: GYAE6OF01BVR67.43.57.F02.1.454.CMB.1.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgagggaaggggctggagtgggtctcagtaataagtggaagtgctggtaccactactttatgcagactccgtgatgggccgttcaccatcctccagagacaattccaagaacacgctgtntctgcaaatgaacngcctagagacgaccgaagaccgaccggccgttaatactttaacgtggacgcgaggacggcgtacgggagaagtaacggtattagtttgtacgttggtttactttgccgtacttactactactacgtcgtttggacgtcgtacggggaccaacgggacccaccggtccaccgtccttccctaccgaccgccctacccgacccggaacggcccccagttccccggttcccttcccccgtacggcccgtccctcgtcccg

SEQ ID NO: 150230 - DNA, 803 bp, Homo sapiens
  misc_feature: GYAE6OF01DI96G.43.57.F02.1.454.CMB.1.raw
  modified_base (218)..(218): a, c, t, g, unknown or other
  misc_feature (218)..(218): n is a, c, g, or t
  modified_base (292)..(292): a, c, t, g, unknown or other
  misc_feature (292)..(292): n is a, c, g, or t
  modified_base (773)..(773): a, c, t, g, unknown or other
  misc_feature (773)..(773): n is a, c, g, or t
tcagtgtgagtagtcacgaccggtgctcgatttagctcgatatagttgggtttggggggctgagctggcttttcttgtggctattttaaaaggtgtccagtctgagagcagctgttggagtcgtgggggagcttgatacaggccgggggggtccctgagactctcctgtgtagcctctggattcaacctttaacaactatgccatcgacctgggtccnccaggctccgagggaggggctggagtggtctacagtaagtaagtggaagtgctggtaaccctataacttttagngaccaagtacctccggtagaacgttcggggtccccgttccacattcctaccgaggagtaactaaacttcccaaaaggaacctacggcttggtcgtaccgtagacaaaagtcgaaaacctagacccgttaaggagaaccggaacccgaaagacccggacgggtaccgtaattaacgtttaccgtggtacggacggaaggtacggggaccgggttacgggaaggtaacggttaacgtaattttaggttttacgttacgtttggttttaacgtttgaccgttacttaacctaccgttaacgttaccgttacgtttacgggacgttccgggtacggggaacccgtaaacgggcccgtaaccgggttacctaacccccgggtttcctacccgttaccgaccggtaaccccccgttacccgaaacccggtaaacccccgggccccgttaaccggttcccccgggttaccccccgtttcccccccggngggtaccccccgtcccgtcccggtacccgg

SEQ ID NO: 150231 - DNA, 624 bp, Homo sapiens
  misc_feature: GYAE6OF01EBC6U.43.57.F02.1.454.CMB.1.raw
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagtgtgagtagtcacgaccggtgctcgatttagctcgatatagttgggtttggggggctgagcgtggtcgttttcttaggtggctaattttaaaaggtgtccagtctgaggagcagctgttggagtcgtgggggaggcttgatacaggccgggggggtccctgagactctcctgtgtagcctctgtattctaacctttaacaactatgccatgacctgggtccgccaggctccgaaggggaaggggctgggagtgggtctcgaagtaataaggtggaagtgctggtaccatactttatgcagactccgtgatcggggcccgttcaaccatcgtccaaggagacaattccaagaacacgctgtntctagacaaatgaacagcctgagacgccgaagcacggtcgtaatatttacngtgcgagaggngtcggagagtaacgattagttttgacttggtttagtttgactcgtaacttactacgtacgttcgtttcggacgttcgtaggggtaccaacgggaccgacggtccgtaccgtcctccgtccaacgtcccgtaccaacccgaccgggaccctacgttacccggttccttcccccccgtggtccccgtcccgtcgtcccg

SEQ ID NO: 150232 - DNA, 635 bp, Homo sapiens
  misc_feature: GYAE6OF01DPEGV.43.57.F02.1.454.CMB.1.raw
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (402)..(402): a, c, t, g, unknown or other
  misc_feature (402)..(402): n is a, c, g, or t
tcagtgtgagtagtcacgaccggtgctcgatttagctcgatatagttgggtttgggggggctgagctggctttttcttgtggctattttaaaaaggtgtccagtctgaggagcagctgttggagtctgggggaggcttgatacaggccgggggggtccctgagactctcctgtgtagcctctggattcacctttaacaactatgccatgacctggtccgccaggctccaggggaagggctggagtgggtctcagtaataagtggaagtgctggtaccacactttatgcagactcgngatgggccgttcaccatcctcagagaacataccaagaacacgctgtntctgacaaatgaaacaggtccagagaacgcccgaaagaccacggccgtaattattacgngtgcgagaggcgtacggagagtacgattatttagacttggtttattgtcgtacttacgtaacttacgtacgtcgtttcggacgtcgtacggggacccaaacggggacccgacggtaccgtaacccgttccgtacccttcgaccggtccccttacccaacccggtaaacggccccgtaacgtccccggttacccgtttcccccccgtagggtccccgccccgttcggtacccgg

SEQ ID NO: 150233 - DNA, 660 bp, Homo sapiens
  misc_feature: GYAE6OF01CGB6B.43.57.F02.1.454.CMB.1.raw
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggcccgggggggtcctgagactctcctgtgtagcctctggattcaacctttaacaactatgccatcgacctgggtccgccaggcctccgaggggaaggggctggaggtgggtctcgagtaaataaggtggaagtgctggtaaccactactttangcagactccgtgagtcgggccgttcaccatcctccagacaacaattccaaagacacgcgtgtcgtctagacaaatgaaacngacctggaacgacgaccgaagacgaccggacgttaattactacgtggtacgacgagagggcgtacgggaagtagtacgtaattagttttagacgttaggtttattcggctactaacttaccttaaccgtacgttcgtttcgggaccgttcggtacggggaccgaacgggtacccgtacggtccgaccgttcctccctcgaccgtcccctaccgaacccggacgggcccctacggttcccggttaccccttcccccggtacggccccgtcccgtcgtaccccgg

SEQ ID NO: 150234 - DNA, 784 bp, Homo sapiens
  misc_feature: GYAE6OF01D08M9.43.57.F02.1.454.CMB.1.raw
  modified_base (262)..(262): a, c, t, g, unknown or other
  misc_feature (262)..(262): n is a, c, g, or t
tcagtgtgagtagtcacgaccggtgctcgatttagctcgatatagttgggtttggggggctgagctggctttttcttgtggctaattttaaaaggtgtccagtctgaggagcagctgttggagtcgtgggggaggcttgatacgaggccgggggggtccctgagactctcctgtgtagcctctgattcaacctttaacaactatgccagtcgaccgtgggtccgccgaggcctccggaagggaaggggctggaggtggtctnaagtaagtaaggtggaagtgcgtcggtaaccactaacttttagcgacacgtaccttccggtagacggttcggggccccgttacacctatccgaccaagtaacgaactaaactaccaaagaacacgtcttaggttcgtaccagtaccgaaaagtcgaaacgacggtaccaggaacgaccgacggaaacgaccgtacgtaccgttaatacgttacgtggacggacggagcggtacggtacggaaggtagtaacgtaatttacgttttagtacgtttaggtttacgttcgtacgtaccttaccgttaactaccgttacggttacgtttcgggaccggttcgggtaccgggaccgtaacgggacccgtaccggtaccgtaccgttcccgtcccgtaccgtacccgtacccctaccccggaaaccggtttaccccgggaccccgttaacccggtttcccccgggttacccccctttccccccgggtaaccgggtcccccccgttcccggtccggttaaccccccggg

SEQ ID NO: 150235 - DNA, 652 bp, Homo sapiens
  misc_feature: GYAE6OF01BVULS.43.57.F02.1.454.CMB.1.raw
  modified_base (284)..(284): a, c, t, g, unknown or other
  misc_feature (284)..(284): n is a, c, g, or t
  modified_base (403)..(403): a, c, t, g, unknown or other
  misc_feature (403)..(403): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgccaggctccgagggagggctggagtgggtctcagtaataagtggaagtgctggtaccacacttttangcagacctcgtgagtcgggccgttcaccatctcagagacataccaagaacacgctgtgtctagacaaatcgaacacgctagagacgaccgaaagccaaccggtcgttaatacgttacgngtagacgaaggacgggtcggtacgggaacgtagtaacgtatttagttttagacgtttggtttaattcgtaccgtaccttaacgttactaccgttaacgttcgtttacggacggttcggtacggggaaccgtaacggggacctaccgggtaccctaccggttcccttccgtacgacgtccctacccgaacccggtacgggcccctacgttcccggttcccgttaccccgaggtccccgtccctcggtccc

SEQ ID NO: 150236 - DNA, 795 bp, Homo sapiens
  misc_feature: GYAE6OF01EPUEI.43.57.F02.1.454.CMB.1.raw
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
tcagtgtgagtagtcacgaccggtgctcgatttagctcgatatagttgggtttggggggctgagcgtggcttttctgtggctattttaaaaggtgtccagtctgaggagcagctgttggagtcgtgggggaggcttgataccaggccgggggggtccctgagactctcctgtgtagcctctggattctaacctttaacaactatgccatcgacctgggtccgccgaggctccgaaggggaagggctggagtggtctacagtaataagtggaagtgctggtaccactacttttagngcaagtactccggtagtacgtcgggcccgttacaaccctntcctaccgaagaacgaacctaacttacccgaaagaacctacgtcttggttactccgtagtaacaaacgtacgaaacacggtacccgaggaacggaacgaacccggaaggaccgacgggtaccttaactatttaaccgnggtacggcggtaaggacgggtacggtacggaacggtaagtacgttaagttagttttacgtacgtttaggtttacgtttcgtaccgtacctttaaccgtacccttaacgttaccggttaccggttttacggtacccgggtaccgtttccgggggaacccggtaaaccggggtaccccgtaacgggttacccgtaaccccggttccctttaccccgaccgtaccgggtacccccttacccgaaacccggaccgggttaccccctacccggttaccccggtttcccccgtccccccgtcgggaccccctcccgttaccgccccgg

SEQ ID NO: 150237 - DNA, 717 bp, Homo sapiens
  misc_feature: GYAE6OF01EVQ1P.43.57.F02.1.454.CMB.1.raw
  modified_base (319)..(319): a, c, t, g, unknown or other
  misc_feature (319)..(319): n is a, c, g, or t
tcagtgtgagtagtcacgaccggtgctcgatttagctcgatatagttgggtttggggggctgagctggcttttctgtggctattttaaaaggtgtccagtctgaggagcagctgttggagtctggggggagcttgatacaggccgggggggtccctgagactctcctgtgtagcctctggattcacctttaacaactatgccatcgaccgtgggtccgccaggcctccgaggggaaggggctggaggtgggtctacaagtaataagtggaagtgctggtaccacactttatgacagactccgtgatcgggccgttcacntctccagacgacaactccaagaacacgctagtgtctgacaatcgaactcgctaggacgacgaccgaaagtaccgaccggtaccgtaataacttacgtggttacggacggaagggacgggtacggttacgggaaggtaacggtaacgttaactttacgttttacggtacgtttagggtttacgttttacggccgtaccgtttaaccgttaccttaacgttaaccgtcgttttacggggtaacccgtccgggttacggggaacccgtaaggggtaacccctaaccgggttaccgacccggttacccttcccgtacccgtaccgcccgttaacccgaacccggtaacggacccctacggtcccgttacccgtccccgtacggccccgtccgtcgtaccccg

SEQ ID NO: 150238 - DNA, 976 bp, Homo sapiens
  misc_feature: GYAE6OF01C1IG5.43.57.F02.1.454.CMB.1.raw
  modified_base (538)..(538): a, c, t, g, unknown or other
  misc_feature (538)..(538): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtcgtgggggaggcttgatacgaggcccggggggtccctgagactctcctgtgtacgcctctggtattccaacctttaaacaactatcgccatcgaccgtcgggtcccgccgaggcctaccggaaggggaaggggcgtgggaggtgggtctacgaagtaaataaggaggtaagtggacttacggtaacccacgttaacttttagtacgactacggtaccgtccggtagtacggtccggggtcccggttaccacctacgtccctaaccgagaacgtaacctaaaccgttaccgaaaagaacctaccggtcgttcggtacggtacctacggaactaaaaggtacgaaaccgtcgacccgtaggaacgaaccggaacccgaaaggacccgtaccgggtaccgttaaatttaacgttacgnggtacgagggaacggacgggtcggtaacgggaagtaaacggttacgttaagtttacggttttacgaacggttttagtttacggttacgtacccgtaaccttttaaaccgtaaccgtttaacccgtttaccgggtttacgttttaaccggggtacccgggtttaaccggggtaccggggggtaaacccccgggtaaaaccggggtaccccggttaaacccggggtacccccgttaaacccgggtttccccccttaaacccggttacccgaccccggtttaaaccccccgaaccccccgggtaaaccccgggtaaaccccgggttcccccccgtaaaaccccgggttttacccccgggtttccccccccccggttttaacccccgggacccggggtttacccccccgttcccccccgggttacccggttaaaccccccgg

SEQ ID NO: 150239 - DNA, 769 bp, Homo sapiens
  misc_feature: GYAE6OF01DMMQJ.43.57.F02.1.454.CMB.1.raw
  modified_base (226)..(226): a, c, t, g, unknown or other
  misc_feature (226)..(226): n is a, c, g, or t
tcagtgtgagtagtcacgaccggtgctcgatttagctcgatatagttgggtttgggggaggcttgatacagccgggggggtccctgagactctcctgtgtagcctctggattcacctttaacaactatgccatgacctgggtccgccaggctccaggggaaggggctggagtgggtctcagtaataagtggaagtgctggtaaccactactttatgcagactccgngatcgggccgttcaccatctccagagacaattaccaagacacgctgtgtctgacaaatagaaacagccgtagaagacggacccgaaggaccgaccgggaccgttattaattacgtaggtcggacggagggagggtccggtacgggaggtaaggtacgtatttaagtttttggtaactttgggtttatttcggaccgttaccttaaccgttaccttaaccgttacggttacgttttcggggaacgtttcggtacgggggacccgaaaccgggacccgtacccggttaccgtacccgtcctaccctacgaccgtaccctaccccgaacccggtaaccgggccccttaccgtccggtttaccccgttcccccgtcgggtccccgtccccgtcgcccgtacccgacgggtaccgacccgacccgtacccgacgggtaacgcccgaaccgacggcccgggtcccggtccggtcggtcccggtccggtaccggtaccggtaaaccggtacccgttacccttaccctaacccttacccgtacctaacccg

SEQ ID NO: 150240 - DNA, 678 bp, Homo sapiens
  misc_feature: GYAE6OF01A4ALI.43.57.F02.1.454.CMB.1.raw
  modified_base (181)..(181): a, c, t, g, unknown or other
  misc_feature (181)..(181): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (661)..(661): a, c, t, g, unknown or other
  misc_feature (661)..(661): n is a, c, g, or t
tcagtgtgagtagtcacgaccggtgctcgatttagctcgatatagttgggtttgggggggctgagctggctttttcttgtggctaattttaaaaggtgtccagtctgaggagcagctgttggagtctgggggaggcttgatacaggccgggggggtccctgagactctcctgtgtagcctntgattcaacctttaaacaactatgccatcgaccgtgggtcccgccaggcctccgaggggaaggggctggagtgggtctcagttaanaaggtggaagtgctggaccactactttangacagactccgtgagtcggggccgttacacctatcctaccaagacaactaattaccaagtaacacggcttgtgtctgacaaatcgaactagctagganacggacgaaagccgaccgggtacttatatacgngtaggcgaggacggcggtacggagtacggtaagttagtttaacgttttcggacgtttagggttttatttcggccgttaccttaacttaccgttaacgttacggttcgtttacgggaccgttcgggtaaccgggtaccgaaccgggaccgtacggtcccaccgttaccgtcctaccgacgtccccgtaccgaacccggtaaccgggccctacgttcccggtaccccttccccggnggccctcccgtcggccc

SEQ ID NO: 150241 - DNA, 779 bp, Homo sapiens
  misc_feature: GYAE6OF01C4QCI.43.57.F02.1.454.CMB.1.raw
  modified_base (141)..(141): a, c, t, g, unknown or other
  misc_feature (141)..(141): n is a, c, g, or t
  modified_base (224)..(224): a, c, t, g, unknown or other
  misc_feature (224)..(224): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtcgtgggggagcttgatacnggccgggggggtccctgagactctcctgtgtagcctctggattctaacctttaacaactatcgccatcgaccgtcggggtccncccgaggccgtccgaagggggaacggggtcgtgggtaggtcgggtctcgtaagtaaagtaggtaggaagtcgtcgtacggtaacccactacgtttagtgacgagtccgtccgtggacggttccgggtcccgttccaccgtatccgtaccgagaacgactaactacccaacgaactaccgcgttgtctacgtacgaactaaacgtcggaaaccgacgtccgtaaggacggaacaccgggtaaacgaaccggtaccggtaccgttaattacgttaaccgtgggtacgtacggagggtacggcgggtacggaggtacggtaacgttacgtttagtttcgttacgttaggtttacgttcgtacgtaccttaacgttacttaacctacttacggtttcggtacggttccggtaccgggacgacggtacccgtacggtaccgtacccgttccgacccgtcgtacccgtcccccgttaccgaaccccggtaacccggtaccccgtaccgttccccggttcccccttcccccggtccggtccccgtccccgtccggtaccccg

SEQ ID NO: 150242 - DNA, 764 bp, Homo sapiens
  misc_feature: GYAE6OF01D92RJ.43.57.F02.1.454.CMB.1.raw
  modified_base (515)..(515): a, c, t, g, unknown or other
  misc_feature (515)..(515): n is a, c, g, or t
  modified_base (735)..(735): a, c, t, g, unknown or other
  misc_feature (735)..(735): n is a, c, g, or t
  modified_base (752)..(752): a, c, t, g, unknown or other
  misc_feature (752)..(752): n is a, c, g, or t
tcagtgtgagtagtcacgaccggtgctcgatttagctcgatatagttgggttgggggctgagctggcttttcttgtggctattttaaaaggtgtccagtctgaggagcagctgttgagtcgtgggggagcttgatacgaggcccggggggtccctgacgactctcctgtgtacgcctctaggtacttcaacctttaacaactatcgaccagtcgaccgtcgggtccgccgtaaggcctaccggaaggggaacggggcgtagggaacggttgggtacctacgaaagttaaagtaaggtggtaaagtcgtacgtacggtaacccacgttaactttagcgacgtaacgtaccgtccggtagtacggtcgggtcccgttaccaaccgtcgtcctacgaaggtaactaaccgtaacgtaacccgaacgaactcgtcgtacgtcgtacgtacgaactaaagtcgaactacgcgtagaacgcgaaaccgacgaccgacgtactaagtaattcgagtgacggngacggcgtacggaagtcgtaagtatttaagttcgtacgtttgtttacgtccacgtaccgttacctactacggtacgttcgttccgggaacggttcgaccgggaaccgtaaccgggccctaaccggttccgaccccgttctccccgaaaggtcccgtaccccgtaacccggaacccggtaccggtacccctccttacccccggggtttccctacccccggnggttacccccttcccgnggtaaacccccg

SEQ ID NO: 150243 - DNA, 884 bp, Homo sapiens
  misc_feature: GYAE6OF01EZNBK.43.57.F02.1.454.CMB.1.raw
  modified_base (146)..(146): a, c, t, g, unknown or other
  misc_feature (146)..(146): n is a, c, g, or t
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
tcagtgtgagtagtcacgaccggtgctcgatttagctcgatatagttgggtttgggggggctgagcgtgtcgttttctggtggctaattttaaaaggtgtccagtctgaggagcagctgttggagtcgtgggggagcttgatacgnggcccggggggtcctgagctctcctgtgtacgcctgtgattcctaacctttaacaactatcgcctatcgtaccgtcgggtcccgccgnggcctcccggaaggggaacgggggtcctagggtgggttgggtacctacgtaaggttaagtaaggtgggtaagtcggcctaggtaaaccnctaacgtttncggtacacgtccgtcggtagtacggtcgggttccgtaccnccgtatccgtaccaaggacaacttaactacccgaaagaaccgtctacgttggtcttcgaccgaaattaatccggaaacgacgttacgaggacgacggtaaccgaacgtaaccggaccgggtaacttacgtaacgtttacggtcgggacgtacggggaaccgtcgggtaccgggtagggaaaccgggttaaagttaccgttaagtttacgtttaggtaccggttttagtttaacgtttcgggtaacttacccttaacggttttaaccttcggttaaccggtttcggtttaccggttccgggttaacgggtaccccggggttaaaccggacccggggttaaaccggtccccgggttctacccccggttttaccgaccccgtttacccggtaacccggttaccccttaaacccgggtaccccggttacccgggtacccctttaaccccgggtcccgttttcccccccggtacccggtacccggttcccccgtcccgtaacggttccccccgggg

SEQ ID NO: 150244 - DNA, 828 bp, Homo sapiens
  misc_feature: GYAE6OF01B8HL4.43.57.F02.1.454.CMB.1.raw
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
tcagtgtgagtagtcacgaccggtgctcgatttagctcgatatagttgggtttgggggggctgagctggctttttcttgtggctaattttaaaaaggtgtccagtctgaggagcagctgttggagtcgtgggggaggcttgatacgagggcccggggggtcctgagactctcctgtgtacgcctcgtggattcctaacctttaaacaactatcgaccatcgaccgttcggggtcccgccgaacggcctaccggaagggggaaggggctgggaggtcgggtctagaagtaataaggtggaagtgcgtaggtacccacttactttagngacaggtacctcggtagacggtcgggtcccgttaccaccagttcctaccgaagacgtaactaaacttacccgaaagaaccacgtcttaggtntcgtacgaactaaatcgaacgacgtaccgtaggaacggtaccggaaccggaacgtaccggaaccggggttaacttaacgtttaacgttaccggttagggacgggtacgggagggtaccgggtaccgggtaacgggaacggtaacggttaacgttaacgttttacgtttaagttcggtttaggtttacgttacggtacctaccgtttaaccttacgttaccgttacttccggggggggtttactaccgggttacgggtaccggggtaaccggtaacgggtacccgtacccggtacgtacccgtccttcccgtaccgtaaccgccccgtaaccaacccgggacccggtacccgtacccggttaccccggttccccgttccccgtaccggtcccctacccggtcgtaccccgg

SEQ ID NO: 150245 - DNA, 794 bp, Homo sapiens
  misc_feature: GYAE6OF01CSC7L.43.57.F02.1.454.CMB.1.raw
tcagtgtgagtagtcacgaccggtgctcgatttagctcgatatagttgggtttggggggctgagctggcttttctgtggctaattttaaaaggtgtccagtctgaggagcagctgttggagtcgtgggggagcttgatacgagggcccgggggtcctggagactctccgtgtgtacgcctcgtaggtacttacctaacctttaaacaactagtcgaccatcgaccgtcgggtcccgaccgacgggcctaccggaaggggtacgggtcgttagggagttcgggtactacgaagtaaagtaaggtggaagtcgcgtacgtaacctaacgtagtttacgagacgtacgaccgttcggaggtacggtccggggtacccgtaccaaccgtacttaccgaccgaagaacgtaaacctaacgtaaccgaaagaccgtaccgtgttagtacgtccgtaagaacctaaagacgaacacggtccagaacgaacgtaccggaagtaccggtaccgtcgttaagtaccgttgtggacgacggaggtaacgggcgggtaacggtaaggtaaccggtattaagtttaacgtttaggacgttttacggttagttacgacttaaccgtaaccttacgttaaccgtccggtttacgtacgggttaccgttaccggggaccggggaaccgtaacgggtaccccgtacggtaccctaccgttccacccgtaccgacccgtacccgtacccaaccggtcccggtaccctacggttccccgtacccgtccccggtcggccctccgtccgtacccg

SEQ ID NO: 150246 - DNA, 635 bp, Homo sapiens
  misc_feature: GYAE6OF01BTAD6.43.57.F02.1.454.CMB.1.raw
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccggggggtccctgagactctcctgtgtagcctctggattctacctttaaacaactatgccatcgacctgggtccgccaggctaccgaggggaaggggctgggagtgggtctacgtagtaaataagtggaagtgctcggtaaccacgtactttangacagtacctcggagtagtccgggtccgttacaaccatcctaccgagaacgactaactaccgaaagtaccacgtacgtgtcgtacagacgtaaanaggaacacggtctaggaacgtacgaccgaaagcgaacggtcttaatacttacgngtgacgnggtaggcgtacggagacgtacgtattagttagacttggttacttgtctacttaactacttacgtacgtactttggcgtcggtacgggactacggaccgaccgtccacgtcctacctgaccgaccctacgaccggacggacctacggtaccgttccgtacccgcgccgtccgttcgacccg

SEQ ID NO: 150247 - DNA, 814 bp, Homo sapiens
  misc_feature: GYAE6OF01B9Q7R.43.57.F02.1.454.CMB.1.raw
  modified_base (95)..(95): a, c, t, g, unknown or other
  misc_feature (95)..(95): n is a, c, g, or t
  modified_base (144)..(144): a, c, t, g, unknown or other
  misc_feature (144)..(144): n is a, c, g, or t
tcagtgtgagtagtcacgaccggtgctcgatttagctcgatataggttggggtttgggggctgagctggtcttttcttgtggctattttaaaggngtccagtctgaggagcagctggttggagtcgtgggggagcttgatacgngggcccgggggtcctagacgctctcgtgtcgtacgcctcgtagtacttacctaacctttaacaacctagtcgaccctagtcggtaccgttcgggacccggaccacgggcctaaccgggagggggaacgggtcgtagggaacggttcgggttacacgtaagtaagtaaggtggaagttcgcgttacggtacccaacgttactttagacgacgacgtacgttaccgaggtacggtaccgggtccgtacctaccgtacaccgtacgaacactaccgggtaactacgaaacgtaccacgtcgtacgtagtacgagaactaacgacaacgacgtccggagaacggaacgacggaacgtaccgacggtactacgttactagacggtacgacgagggtacggacgacgggaagtacgttacgttaacgtttagtttacgtacgtttaggtttacgttacgtccttaaccgttaacgtaacttaccggttacggtttaccggttacggtacccgggtacgggtaccgggtaacccgggtacgggtaaccccgtacggttaccccggtaccgttaccgtaccccgttacgacccgttacccgttaccgaacccggtaccccggtacgttacccgtacccggttccccgtaccggtcccgtcccgcccgtcgtaacccgg

SEQ ID NO: 150248 - DNA, 971 bp, Homo sapiens
  misc_feature: GYAE6OF01DH5G3.43.57.F02.1.454.CMB.1.raw
  modified_base (246)..(246): a, c, t, g, unknown or other
  misc_feature (246)..(246): n is a, c, g, or t
tcagtgtgagtagtcacgaccggtgctcgatttagctcgatatagttgggtttgggggctgagctggtctttttcttgtggcttattttaaaggtgtccagtctgaggagcagcttgttggagtcgtgggggagtcttagattacgagggccgggggggtccctgacgtactctcctgtgtacgccttcgtggtacttacctaacctttaacaacttatcgctagtccgtaccgttcggggtcccnccgaacggccgttccgggaagggggtaggggcgttagggtggtcgggtacctagtaagttaaacgttagggtggtaagtcggtcgtacggttaaccccacttaacgtttatcgaccgattacccggtccggtagaccggttcgggtacccggtttaccacccgtacttccccacggaaggtacgtaaacctaaccgtaaccaaacgtaacccgtacgttcttaggttccctagtaaccgacgtaaaacttacggaaaaccgccggtacccggtaagggacgtaaacccggaacccggaaaccggtaacccggacgggtttaacccttaaggttttaccttaacggttggtaaccggcgggaaacgggtccgggtaaccgggggtaccgtaaagggttaacccgtttaaaggttacggtttttaaggttttacggtttaccggtttgggtttttaacgtttccggttacccgtttacccgtttaactaaccccgttttaacgttaccggtttcgtttacccgggttacgggttacggttacccggggaaaccgggtaacccgggttaccgaccccggttaccgtacccccgtttctaacccccgttagaccccggtacccccgtaaccccggaacccggtacccccggtacccccttacgggttacccccggtttaccccttccccccggggttcgaaccccccggtcggtccccggtacccccgg

SEQ ID NO: 150249 - DNA, 704 bp, Homo sapiens
  misc_feature: GYAE6OF01EZUJE.43.57.F02.1.454.CMB.1.raw
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (573)..(573): a, c, t, g, unknown or other
  misc_feature (573)..(573): n is a, c, g, or t
  modified_base (629)..(629): a, c, t, g, unknown or other
  misc_feature (629)..(629): n is a, c, g, or t
  modified_base (693)..(693): a, c, t, g, unknown or other
  misc_feature (693)..(693): n is a, c, g, or t
tcagtgtgagtagtcacgaccggtgctcgatttagctcgatatagttgggtttgggggaggcttgatacaggccgggggggtccctgagactctcctgtgtagcctctggattccacctttaaacaactatgccatcgaccgtggggtccgccaggcctccgagggagggctggagtggtctnagtaatagtggagtgctgtaccactacttangcagactcgngagtcgggccgtcacatccgtcaganacactacaagacacgctgtntctgacaagtcgaacagctaggagacggaccgaagacaccggacctattactacggtgtcggaggtacggcgggtcggtaggagtaacgtaacgtatttagtttacgagtttaggtttattcggacgtacttacctacgttataccgtcggtttacggacgtcggtacgggaccggaacggactccggtcctacgttcccacctcgacctccctaacccgaccggaaccgggtcccaccgttccggtccccttacccccggcggtacccgcccgtcctccggccgtaccgggtacctaccccncggttaccgacgccggtaccacgggtaccgggccccgggtccggttcggggacccnccggtacgggtccggttaaacggtaaccccggttaccccgtttacgaccccttaccttaacccncccggtaaacg

SEQ ID NO: 150250 - DNA, 800 bp, Homo sapiens
  misc_feature: GYAE6OF01AYSQX.43.57.F02.1.454.CMB.1.raw
  modified_base (149)..(149): a, c, t, g, unknown or other
  misc_feature (149)..(149): n is a, c, g, or t
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (754)..(754): a, c, t, g, unknown or other
  misc_feature (754)..(754): n is a, c, g, or t
tcagtgtgagtagtcacgaccggtgctcgatttagctcgatatagttggggtttgggggggctgagcgtggtcttttctggtggctaattttaaaaggtgtccagtctgaggagcagctggttaggagtcgtgggggagcttgatacgngggccggggggtcctgagctctcctgtgtagtcctgtagtattacactttaacactatcgcagtcgaccgtcgggtccnccgagcctacggaagggacgggctggaggtcgggtacctagaagttaagtaaggtaggaactcgcgtacgacctactatttancganacgtacgtcgtaggacgtcggggtccctacacctacgttccaccgagaaccgtaacttaacgttaacccgaaaggaacctcgccgttaggtccgtacctaaggtaactaaacgtacggaacgtaacggtcccgaggaacgaccggtaaccgtaaaccggacgtaccgggttaaaccggtttattaaacgtacggttcggaacgggaaggacgggtcgggtaaccgtgggtaaacggttacgttaacggtttatttacgtttagtaccgggttttaggtttcgtaccgtagttaaccttacccgttaacttaggtccggtttagttccgggacggtttaccgggcgggtaaaccgggtacccggtaccgtaccggttaccgtaccggtccctcgtaccggtaccgtaccccggtacgaacccgggttcgaaccccgtttntcccccgggttaccttcccgggcccgtccctaccgtcggtacccgg

SEQ ID NO: 150251 - DNA, 676 bp, Homo sapiens
  misc_feature: GYAE6OF01E1SQH.43.57.F02.1.454.CMB.1.raw
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (610)..(610): a, c, t, g, unknown or other
  misc_feature (610)..(610): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacaggccgggggggtccctgagactctcctgtgtagcctctggattcaccttttaacaactatgccagtgacctgggtccgccaggcctccgagggagggctggagtggtctacagtaatagnggaagtgctggtaccatactttangacagtactcgtgagtcggggccgttcacctatccgaccaagtacgactaaacttaccaaagaacctacgtcgttagtacgtcgtagacctaaatgaaaccacgtcccgtaggaacggaacggacccggaaaacgacccgtacccggtaccgtttaattaacctttacgtggtacggacggaagggtacgggtcggtacgggaagtaacggtaacgttatttaacgttttagacgtttggtttagttcgcgtactactacgtactacgtcgttacggtaccgtggtacgggaccacgggtaccacggtcctacggttcctacccncgaccgtcccgaccaacggaccgacctacgttcccgtcccgttcccgagtcccgcccgtgtacccg

SEQ ID NO: 150252 - DNA, 748 bp, Homo sapiens
  misc_feature: GYAE6OF01C8TZ3.43.57.F02.1.454.CMB.1.raw
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (734)..(734): a, c, t, g, unknown or other
  misc_feature (734)..(734): n is a, c, g, or t
tcagtgtgagtagtcacgaccggtgctcgatttagctcgatatagttgggttggggggctgagctggtctttttcttgtggctattttaaaaggtgtccagtctgagagcagctgttggagtcgtggggagcttgatacagggcccggggggtccctgagacctctcctgtgtacgcctcgtgtacttacctaacccttttaaacaacttatcgcccaagtcgacccgtcgggtcccgaccgacggcccgtacccggaagggggaacgggggtcgtgggtaggttcgggtcctagaagttaaagtaaggtaggaacgtggacgttacggtaaccacttatttacgngaccagtacctccggtgacgtcggccgtacactactcgacagacacgaactaccgaagacactcgtgtactcganactaaagtnaaccgacgtacgacggacgaacgaccgaacgtacccggaccggtaacgtactttaagttcgtaggtacgacggtaacggtcgggtacggttacgggaaaggttacgttaacgttagtttaacgttgttaccgtttaggtttactcgcgtacttactacgtcgttacgtcgttagggtaccgtgggtaccggacgtaaccgggacctacggtcctacccgttccaccgtccgacccgaccctacccggaccggtaacccggtccgtacccgttcccggttcccccgttccgtacccggtcccccncgtcccggtacccg

SEQ ID NO: 150253 - DNA, 805 bp, Homo sapiens
  misc_feature: GYAE6OF01ETPOW.43.57.F02.1.454.CMB.1.raw
  modified_base (365)..(365): a, c, t, g, unknown or other
  misc_feature (365)..(365): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
tcagtgtgagtagtcacgaccggtgctcgatttagctcgatatagttgggtttgggggggctgagctggtctttttctgtggcttaattttaaaaggtgtccagtctgaggagcagctgttggagtcgtgggggagcttgatacgacggggcccgggggggtcctagacgtacttctccgtgtgtacgccttcgtggtactttacctaaccctttaaacaacttagtcgcctaagtcgtaccgttcggggtcccgaccgaggtcctacgggaaaggggtaggggtctagggtgggtcggttacacggtaaggttaaagtagggtaggtaaggtcgtcgttaacggacctaacgttaacgtttagngaacctaggtacctccggtaggacggttccggggtcctaacgacctactcaccgaagtacaactacgtaacagaacncgtntcgtncgtaaatagacagcgtacgagacgacgacgacgacgtacgtacgttagtatcgtggacgtacggacgggtacggacgtacggtaacggtaagtaaacgttagtttagtttacggtttacgtttaacgtttcgttacgttaaccgttaaccgttaccgtttaaccttacgggtttaccgttacgggttaacggtccggtaccggggtaacgggtaacccggtaaccgggttacccgtaccggtaccctaccgttcccgtaacctaccgtaaccggtccctaacccggaaccggtaccggtccctacccggtttaccccgtccccgttcccggaccgtcccgtcccgtagtcccgg

SEQ ID NO: 150254 - DNA, 747 bp, Homo sapiens
  misc_feature: GYAE6OF01CMAW4.43.57.F02.1.454.CMB.1.raw
  modified_base (155)..(155): a, c, t, g, unknown or other
  misc_feature (155)..(155): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
  modified_base (656)..(656): a, c, t, g, unknown or other
  misc_feature (656)..(656): n is a, c, g, or t
tcagtgtgagtagtcacgaccggtgctcgatttagctcgatatagttgggtttggggggctgagctggtctttttctgtggctaattttaaaaggtgtccagtctgagagcagctgtggagtcgtggggagcttgatacgagggccgggggtccngagactctctgtgtacgcctcgtggtactactaacctttaaacaactatcgccatcgtacctcgggccgacacggctacgagggaagggntggacggtggtactanaagtaaagtaggtagaagtgacgtacggtacctaacgtactttaancgacgtacgaccgtcgtggtaacgtccgggtaccgtaaccaaccgtataccgtaccgaagaccgtaaactaacctaaaccgaaacgaaccacgtcgtagtcgtacgtacgaacaaagtacgaaacgtacggccaaggaacgaaccggaacgaaacgacgtaaccgggtactaaattacgtacgtacggtagacggaggacggccggtaggagtaaacgtagttaactttacggttagtacgttaggttattaccgaccgttataacgttaacgtaaccgttacgtcgtaacggtcggtacgggtaggaaccggtacggaaccaccggggtacctcgtacccgtccgtanacccggtacccaccccggttaaacggaccgtacccggttaccgtcccggttacccccgttacccggaggtaccctcccgtagtaaccccgg

SEQ ID NO: 150255 - DNA, 556 bp, Homo sapiens
  misc_feature: GYAE6OF02I33OM.43.57.F02.1.454.CMB.1.raw
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (388)..(388): a, c, t, g, unknown or other
  misc_feature (388)..(388): n is a, c, g, or t
  modified_base (541)..(541): a, c, t, g, unknown or other
  misc_feature (541)..(541): n is a, c, g, or t
tcagtgtgagtagtcacgaccggtgctcgatttagctcgatatagttgggtttgggggctgagcgtggcttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgccaggctccagggaagggctggagtgggtctcagtaataagtggaagtgctggtaccanactttangcagactccgtgatgggccgttcaccatctccagagacaattccaagaacacgctgtgtctgacaaatgaaacagcctgagagccgaagacacggcctatattacngtgcgagaggcgtcggagagtacgatatttgacttggttaatttgcgtcttactactactacgtctttggacgtcgtcggggccaagggccacggtcaccgtcctcctacgcgccctccaccgtaacggcccacgttccggtcccttccccgnggccgtccctgcccg

SEQ ID NO: 150256 - DNA, 548 bp, Homo sapiens
  misc_feature: GYAE6OF02IANZE.43.57.F02.1.454.CMB.1.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
tcagtgtgagtagtcacgaccggtgctcgatttagctcgatatagttgggtttgggggctgagcgtgcgttttcttaggtggctattttaaaaggtgtccagtctgaggagcagctgttggagtctgggggaggcttgatacaggccggggggtccctgagactctcctgtgtagcctctggattcacctttaanaactatgccatgacctgggtccgcaggctcagggaagggctggagtgggtctcagtaataagtggaagtgctggtaccacactttangcagactccgtgatgggccgttcaccattctccagagacaattccaaagaacacgctagtgtctgcaaatgaacagcctgagagccgaaagcacggcctatattacgtgtagcgagacggcgtcggagagtacgatacttttgactggttatttgcgtctactactactagctttggacgtctgggacctaagggaccacggtcgaccgtctccgtcagcctccaccaagggcccagtcggtccttcccctggcctccctgtcccg

SEQ ID NO: 150257 - DNA, 553 bp, Homo sapiens
  misc_feature: GYAE6OF02HLPJT.43.57.F02.1.454.CMB.1.raw
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgacaaatgaacagcctgagagccgaagacacggcctatattactgtgcgagaggcgtcggagagtacgatatttgacttggttatttgcgtctactactactacgctttggacgtcgtggggaccaagggaccacggtccaccgtcctcctcacgcctccaccgaacggcccagtccggtccttcccccgtcggccgtcccgtgcccg

SEQ ID NO: 150258 - DNA, 568 bp, Homo sapiens
  misc_feature: GYAE6OF02IDAY5.43.57.F02.1.454.CMB.1.raw
  modified_base (549)..(549): a, c, t, g, unknown or other
  misc_feature (549)..(549): n is a, c, g, or t
tcagtgtgagtagtcacgaccggtgctcgatttagctcgatatagttgggtttggggggctgagcgtggcttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattcccaagaacacgctgtgtctgcaaatgaaacagcctgagagccgaagaccacggccgtatattactgtgcgagaggcgtcggagagtacgattattttgacttggttatttgcgtctactactactacgtctttaggacgttcgtggggccaaggggacccacggtcacccgtctccctcacgccctcccaccgaacgggcccagtccggtccttcccccgngggccgtccccgtgtcccg

SEQ ID NO: 150259 - DNA, 563 bp, Homo sapiens
  misc_feature: GYAE6OF02JBTT3.43.57.F02.1.454.CMB.1.raw
  modified_base (282)..(282): a, c, t, g, unknown or other
  misc_feature (282)..(282): n is a, c, g, or t
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
tcagtgtgagtagtcacgaccggtgctcgatttagctcgatatagttgggtttgggggctgagctggcttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgccaggctccagggaaggggctggagtgggtctcagtaataagtggaagtgctggtaccacactttangcagactccgtgatgggccggttcaccatctccagagacaattccaagaacacgctgtgtctgcaaatgaacagcctgagagccgaagacacggccgtatactactgtgcgagaggcgtcggagagtacgattagttttgacgttggtttatttggcgtcttaactactactacgtctttaggacgtcgtgggaccaagggaccacggtcaccgtcctcctacacgccctccaccgtaacggccctagtccggtccttccccgnggcccgtcccncgtccg

SEQ ID NO: 150260 - DNA, 579 bp, Homo sapiens
  misc_feature: GYAE6OF02INDSN.43.57.F02.1.454.CMB.1.raw
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
tcagtgtgagtagtcacgaccggtgctcgatttagctcgatatagttgggtttgggggctgagcgtgtcgttttctaggtggctaattttaaaaggtgtccagtctgaggagcagctgttggagtctgggggaggcttgatacaggccggggggtccctgagactctcctgtgtagcctctggattcacctttaaacaactatgccatgacctgggtcccgccaggctccgagggaaggggctggagtgggtctcagtaataagtggaagtgctggtaccactactttatgcagactccgtgatgggccgttcaccatctccagagacaattccaaagacacgctgtgtctgacaaatgaaacngcctggaagagccgaaagacacggctaatattactgngcgagaggcgtcggagagtacgattatttgacttggttatttgcgtcttaactactactacgtcttggtacgtcgtcgggaccgaacgggaccgacggtccaccgtctacctcgacgccctaccacccgaacggcccaacgttccggttccttcccccgtcggcccgtccctgtcccg

SEQ ID NO: 150261 - DNA, 560 bp, Homo sapiens
  misc_feature: GYAE6OF02I6C0Z.43.57.F02.1.454.CMB.1.raw
  modified_base (276)..(276): a, c, t, g, unknown or other
  misc_feature (276)..(276): n is a, c, g, or t
tcagtgtgagtagtcacgaccggtgctcgatttagctcgatatagttgggtttgggggctgagcgtggcttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccanactttatgcagactccgtgatgggccggttcaccatctccagagacaattccaagaacacgctgtgtctgcaaatgaacagcctgagacgccgaagacacggcctatattactgtgcgagaggcgtcggagagtacgatatttgactggttatttgcgtctactactactacgtctttggacgtcgtcgggtccaagggaccgacggtcgaccgtcctcctcgacgtcctaccaccgaacgggccccagtccggtccttcccccgtggccgtcccgtcgtcccg

SEQ ID NO: 150262 - DNA, 553 bp, Homo sapiens
  misc_feature: GYAE6OF02GFDSR.43.57.F02.1.454.CMB.1.raw
  modified_base (285)..(285): a, c, t, g, unknown or other
  misc_feature (285)..(285): n is a, c, g, or t
  modified_base (388)..(388): a, c, t, g, unknown or other
  misc_feature (388)..(388): n is a, c, g, or t
tcagtgtgagtagtcacgaccggtgctcgatttagctcgatatagttgggtttgggggctgagcgtggcttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgagggaaggggctggagtgggtctcagtaataagtggaagtgctggtaccacactttangcagactccgtgatgggccgttcaccatctccagagacaatccaagaacacgctgtgtctgacaaatgaacagcctgagagccgaagacacggctatattacngtgcgagaggcgtcggagagtacgattatttgacttggttatttgcgtctactactactacgtctttggacgtcgtcgggaccgaagggaccacggtcaccgtctcctcacgccctaccaccgacggcccacgtccggtccttccccgtggccgtcccgtgtccg

SEQ ID NO: 150263 - DNA, 557 bp, Homo sapiens
  misc_feature: GYAE6OF02G8NL6.43.57.F02.1.454.CMB.1.raw
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccanactttatgcagactccgtgatggggccgttcaccatctccagagacaattccaagacacgctgtgtctgcaaatgaacagcctgagagccgaagacacggccgtatattacngtgcgagaggcgtggagagtacgatatttgacttggttatttgcgtctactactactacgtctttggcgtcgtcgggaccaagggaccgacggtcgaccgtctcctcacgccctccaccgaacggccctagtccggttcccttcccccgtcggcccgtcccgtgtcccg

SEQ ID NO: 150264 - DNA, 572 bp, Homo sapiens
  misc_feature: GYAE6OF02H1MKZ.43.57.F02.1.454.CMB.1.raw
tcagtgtgagtagtcacgaccggtgctcgatttagctcgatatagttgggtttgggggaggcttgatacagccggggggtccctgagactctcctgtgtagcctctggattcacctttaacaactatgccatgacctgggtccgccaggctccagggaaggggctggagtgggtctcagtaataagtggaagtgctggtaccacactttatgcagactccatgatgggccggttcaccatctccagagacaattccaagaacacgctgtgtctgcaaatgaacagcctgagagccgaagacacggccgtatattactgtgcgagaggcgtcggagagtacgattatttgacttggttattgcgtctactactactacgtctttggacgttctggggccaagggacccacggtcaccgtctcctcacgcctccaccgaacgggcccagtccggtccttccccctcggccgccctcgcctccgaggcgccaccctccgaagacgccacgacggccggcccgtgggcctcggcccgttggtaccgaacggaccttaccttacccacctacctacc

SEQ ID NO: 150265 - DNA, 605 bp, Homo sapiens
  misc_feature: GYAE6OF02II66Y.43.57.F02.1.454.CMB.1.raw
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (540)..(540): a, c, t, g, unknown or other
  misc_feature (540)..(540): n is a, c, g, or t
tcagtgtgagtagtcacgaccggtgctcgatttagctcgatatagttgggtttgggggcgtgagcgtggcgtttcttggtggctatttaaaaggtgtccagtctgaggagcagctgttggagtctgggggaggcttgatacaggccgggggggtccctgagactctcctgtgtacgcctctggattcacctttaacaactatgccatgacctgggtccgccaggctccagggaaggggctggagtgggtctgagtaataagtggaagtgctggtaccatactttatgcaagctccgtgatggggccgttcacccatcctccagacgacaattccaaagaacacgtctgtgtcngacaatgaacncgcngagacgacgaagacgaacggtacgtaatacgttacgtgtcgagaggacggacggtacgggaggtagtaacgtaagttagtttagtagttagttagttagtcgtactactactactacgtcgttacgtacgtcgtcggacgaacggaccgacgtaccgtaccgtcctcctccnccgtccctaccaccgaccgaccgtaccgtccgtcccgtccccgtccggtcccgtcccgtcgtccg

SEQ ID NO: 150266 - DNA, 582 bp, Homo sapiens
  misc_feature: GYAE6OF02IAAKP.43.57.F02.1.454.CMB.1.raw
  modified_base (284)..(284): a, c, t, g, unknown or other
  misc_feature (284)..(284): n is a, c, g, or t
tcagtgtgagtagtcacgaccggtgctcgatttagctcgatatagttgggtttggggggctgagcgtggcttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaagggctggagtgggtctcagtaataagtggaagtgctggtaccacacttttangcagactccgtgatgggccggttcaccatctccagagacaattccaagaacacgctgtgtctgacaaatgaacagcctgagagccgaaagccgacggccgtatattactaggtgcgaggaggcgtcggagagtagattatttgtattggttatttgcgtctactactactacgtctttggtactcggtgggccgaaacgggacccgacggtacctacccgtctccctcgacgtccctacccaccgaaccggcccacgttccggttcccttcccccgtcgggcccgtcccctcgtcccg

SEQ ID NO: 150267 - DNA, 568 bp, Homo sapiens
  misc_feature: GYAE6OF02FNBCZ.43.57.F02.1.454.CMB.1.raw
tcagtgtgagtagtcacgaccggtgctcgatttagctcgatatagttgggtttgggggaggcttgatacagccggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaaagaacacgctgtgtctgcaaatgaacagcctgagagccgaagacacggccgtatattactgtgcgagaggcgtcggagagtacgatattttgactggttatttgcgctactactactacgcttttggacgtcgtgggccaagggaccacggtcaccgtctcctcacgcctccaccaagggcccatccggtccttccccctggccgccctgcctccgaggacgcacctccgagacgccacacgcggcccgtgggcctcggccctggtccaacgggtaccttaaccgtttcccaaccttacctactaacccg

SEQ ID NO: 150268 - DNA, 549 bp, Homo sapiens
  misc_feature: GYAE6OF02H1YF7.43.57.F02.1.454.CMB.1.raw
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaagggctggagtgggtctcagtaataagtggaagtgctggtaccacacttttatgcagactccgtgatgggccggttcaccatctccagagacaattccaaagaacacgctgtgtctgcaaaatgaacagcctgagagccgaaagacacggccgtaatattactgtgcgagaggcgtcggagagtacgatattttgacttggttatttgcgtctactactactacgctttggacgtctggggccaagggccacggtcaccgtctcctcacgcctccaccaacggcccatccggtccttcccccgtggccgtccctgcccg

SEQ ID NO: 150269 - DNA, 565 bp, Homo sapiens
  misc_feature: GYAE6OF02H2PXF.43.57.F02.1.454.CMB.1.raw
  modified_base (285)..(285): a, c, t, g, unknown or other
  misc_feature (285)..(285): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacacttttangcagacctccgtgatgggccggttcaccatctccagagacaattccaagaacacgctgtgtctgcaaatgaacagcctgagagaccgaagacacggcctaatattactgtgcgagaggcgtcggagagtacgattatttgtacttggttatttgcgtcttactactactacgtctttggacgtcgtcgggccgaaggccgacggtcaccgtctcctcacgtccctccaccgaacgggcccagttccggtcccttcccccgtcggcccgtccctcgtcccg

SEQ ID NO: 150270 - DNA, 568 bp, Homo sapiens
  misc_feature: GYAE6OF02F0T0D.43.57.F02.1.454.CMB.1.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagtgtgagtagtcacgaccggtgctcgatttagctcgatatagttgggtttggggggctgagcgtggcttttcttgtggctattttaaaaggtgtccagtctgaggagcagctgttggagtctgggggaggcttgatacagccgggggggtccctgagactctcctgtgtagcctctggattcacctttaacaactatgccatgacctgggtccnccaggctccagggaggggctggagtgggtctcagtaataagtggaagtgctggtaccanactttatgcagactccgtgatgggccggttcaccatctccagagacaattccaagaacacgctgtgtctgcaaaatgaacagcctgaacgagccgaaagacgacggccgtatattactgtgcgagaggcgtcggagagtacgattatttgacttggttatttgcgtctactactactacgtcttaggcgtcgtcggggccgaacgggaccacggtcaccgtcctcctcacgtcctaccacccgaacgggccctagtccggttccttcccccgtggcccgtcccgtcgtcccg

SEQ ID NO: 150271 - DNA, 564 bp, Homo sapiens
  misc_feature: GYAE6OF02H21H3.43.57.F02.1.454.CMB.1.raw
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (392)..(392): a, c, t, g, unknown or other
  misc_feature (392)..(392): n is a, c, g, or t
tcagtgtgagtagtcacgaccggtgctcgatttagctcgatatagttgggtttgggggctgagcgtggcgttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccanacttttangcagactccgtgatgggccggttcaccatctccagagacaattccaagaacacgctgtgtctgacaaatgaacagcctgagagccgaaagacacggcttatattacngtgcgagaggcgtcggagagtacgattattttgacttggttatttgcgtctactactactacgtctttggacgtcgtcgggacaagggtaccacggttcaccgtctcctacgacgcctccaccgaacgggccctaagtccggttccttcccccgcggtccgcccgtgtcccg

SEQ ID NO: 150272 - DNA, 557 bp, Homo sapiens
  misc_feature: GYAE6OF02GV80J.43.57.F02.1.454.CMB.1.raw
tcagtgtgagtagtcacgaccggtgctcgatttagctcgatatagttgggtttggggggctgagctggctttttcttgtggctattttaaaaggtgtccagtctgaggagcagctgttggattctgggggaggcttgatacagccgggggggtccctgagactctcctgtgtagcctctggattcacctttaacaactatgccatgacctgggtccgccaggctccagggaagggctggagtgggtctcagtaataagtggaagtgctggtaccacactttatgcagactccgtgatgggccggttcaccatctccagagacaattccaagaacaagctgtgtctgcaaatgaacagcctgagagccgaagacacggccgtatattactgtgcgagaggcgtcggagagtacgatatttgacttggttatttgcgtctactactactacgtctttaggacgtcgtggggccaagggaccacggtcaccgtctccctcacgccctccacccaacgggccccagtccggtccttcccccgtggcccgtcccctgtcccg

SEQ ID NO: 150273 - DNA, 548 bp, Homo sapiens
  misc_feature: GYAE6OF02JDZMG.43.57.F02.1.454.CMB.1.raw
  modified_base (506)..(506): a, c, t, g, unknown or other
  misc_feature (506)..(506): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggtgctggagtgggtctcagtaataagtggaagtgctggtaccacactttatgcagactccgtgatgggccgttcaccatctccagagacaattccaagaacacgctgtgtctgcaaatgaacagcctagagagaccgaagacacggcctatattactgtgcgagaggcgtcggagagtacgattatttgacttggttatttgcgtctactactactacgctttggacgttcgtggggaccaagggaccacgggtcaccgtctcctcgacgcccnccaccgacggcccacgtccggtccttccccgcgccgccctcg

SEQ ID NO: 150274 - DNA, 563 bp, Homo sapiens
  misc_feature: GYAE6OF02IBXN6.43.57.F02.1.454.CMB.1.raw
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctggggggaggcttgatacagccgggggggtccctgagactctcctgtgtagcctctggattcacctttaacaactatgccatgacctgggtccgcaggctccagggaagggctggagtgggtctcagtaataagtggaagtgctggtaccacactttangcagactcgtgatgggccgttcacatctccaganacaattccaagaacacgctgtgtctgacaaaatgaacagcctgagagaccgaaagcacggccgtaatattacgtgtgacgagaggcggtggagagtacgatatttgacttggttatttgcgtactactactactacgtcttggacgtcgtgggaccgaagggaccaggtccaccgtctcctcacgcctaccaccgaacgggtcccacgttccggtcccttcccccgtggtcccgccccgtgtcccg

SEQ ID NO: 150275 - DNA, 571 bp, Homo sapiens
  misc_feature: GYAE6OF02IZ9ZB.43.57.F02.1.454.CMB.1.raw
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
  modified_base (567)..(567): a, c, t, g, unknown or other
  misc_feature (567)..(567): n is a, c, g, or t
tcagtgtgagtagtcacgaccggtgctcgatttagctcgatatagtcgggtttgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaaatgaaacagcctgagagccgaagacacggccgtatattactgtgcgagaggcgtcggagagtacgatatttgactggtttattgcgctactactactacnctttggacgtcgtggggccaagggaccctacggtcaccgtctcctcacgcctaccaccaacgggcccatccggtccttcccccgtggccgtccctgcctccgacgganccaacccgtccgagacgccacacgccggcccgtgggacctggcccgttggtaccaacggaccttacttcccaacttaccncaac

SEQ ID NO: 150276 - DNA, 582 bp, Homo sapiens
  misc_feature: GYAE6OF02ICKWE.43.57.F02.1.454.CMB.1.raw
tcagtgtgagtagtcacgaccggtgctcgatttagctcgatatagttgggtttggggggctgagcgtggcttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccaggggaaggggctgggagtgggtctcagtaataagtggaagtgctggtaccacacttttatgcagactccgtgatgggccggttcaccatcctccagagacaattccaagaacacgctgtgtctgcaaatgaacagcctgagagccgaagacacggcgtatattactgtgcgagaggcggtcggagagtacgattatttgattggtttatttgcgctactactactacgtcttggacgtcgtcggggccaacgggaccacggtccaccgtcctccgtaccacgcctcccgaaccgaaccgggcccctaacgttcccggttcccttccccccgtgggccccgtcccccgtgtccccg

SEQ ID NO: 150277 - DNA, 549 bp, Homo sapiens
  misc_feature: GYAE6OF02H9ZAM.43.57.F02.1.454.CMB.1.raw
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagtgtgagtagtcacgaccggtgctcgatttagctcgatatagttgggtttggggaggcgttgatacagccggggggtcccgtgagactctcctgtgtagcctctggattcacctttaacaactatgccatgacctgggtccgccaggctccagggaagggctggagtgggtctcagtaataagtggaagtgctggtaccacatttangcagactccgtgaatgggccggttnaccatctccagagaacaattccaaagaacacgtctgtgtctagcaaattagaacagcctgagagccgaanacgacggccgtatactaacngtgcgaggagcgtcggagagtacgattaatttgacgtggttatttgcgtcagtactactaacgctttgacgtctgggcaaaggtccaggtcaccgtctcgtcagcctcacccaaggccctatcgcttcccctgaccgccctagcctccaaggccncgtaccnccgngaancaccagtcggccgtcggcgtgccgtgacgtaacgactacctccaactcctacac

SEQ ID NO: 150278 - DNA, 564 bp, Homo sapiens
  misc_feature: GYAE6OF02GPA0S.43.57.F02.1.454.CMB.1.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaagggctggagtgggtctcagtaatagtggaagtgctggtaccanactttangcagactccgtgatgggccggttcaccatctccagagacaattccaaagaaccacgctgtgtctgacaaatgaacagcctgagagccgaaagaccgacggcctaatacttactgtgacgagaggcgtcggagagtacgattatttgacgttggttatttgcgtctactactactacgtctttggacgtcgtcgggaccaagggtaccacggtccaccgtcctcctcacgccctaccaccgacggccctagtccggtcccttccccgtggcccgtccctcgtcc

SEQ ID NO: 150279 - DNA, 615 bp, Homo sapiens
  misc_feature: GYAE6OF02F6XRG.43.57.F02.1.454.CMB.1.raw
  modified_base (285)..(285): a, c, t, g, unknown or other
  misc_feature (285)..(285): n is a, c, g, or t
tcagtgtgagtagtcacgaccggtgctcgatttagctcgatatagttgggtttggggggctgagcgtgcttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccaggggaaggggctggagtgggtctcagtaataagtggaagtgctggtaccacactttangcagactccgtgatgggccgttcaccatctccagagacaattccaagaacacgctgtgtctgacaaatgaacagcctagagagaccgaagacacgggcctatacttactgtgcgaggaggcgtcggagtagtacgtattagtttgacgttggtttattgtcgtcttactactacttacgtcgttggacgtcgtcgggaccgtaacgggacctacggtccgaccgttcctcccgtcgaccggtccctaccccgaaccggaacccgggtcccctaacgttcccggttccccgtttacccccggtcgggtccccgtccccgtccggtacccgg

SEQ ID NO: 150280 - DNA, 624 bp, Homo sapiens
  misc_feature: GYAE6OF02G9UL4.43.57.F02.1.454.CMB.1.raw
  modified_base (291)..(291): a, c, t, g, unknown or other
  misc_feature (291)..(291): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagtgtgagtagtcacgaccggtgctcgatttagctcgatatagttgggtttggggggctgagcgtggcgttttctaggtggctattttaaaaggtgtccagtctgaggagcagctgttggagtctgggggaggcttgatacagccgggggggtccctgagactctcctgtgtacgcctctggattcacctttaacaactatgccatgacctgggtccgccaggctccgagggaagggctggagtgggtctcgaagtaataagtggaagtgctaggtaccactactttangacagactcgtgagtcgggccgttacaccagtctaccagtacgaactaataccaaagaacacgctgtgtactgactaaatgaactacgctganacgacgaagacacggctatactcgntcgacgagacggnggtcgggaatacggtatattagtttgacgttggtttatttcggacgtcttaccgtaatacgtacgtctttaggcgtcggtacgggaccaaacggggaccgtaccggtacgtacccgtccttaccgcctacggccccttaaccgaccgtaacgggcccctaagttcccggttacccttccccgcggacccgtcccctgacccg

SEQ ID NO: 150281 - DNA, 553 bp, Homo sapiens
  misc_feature: GYAE6OF02GPCCB.43.57.F02.1.454.CMB.1.raw
  modified_base (434)..(434): a, c, t, g, unknown or other
  misc_feature (434)..(434): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaagggctggagtgggtctcagtaataagtggaagtgctggtaccacactttatgcagactccgtgatgggccggttcaccatctccagagacaattccaagaacacgctgtgtctgcaaatgaacagcctgagagccgaagacacggcctatattactgtgcgagaggcgtcgggagagtacgatattttgactggttatttgcnctactactactacgtctttggacgtcgtggggccaagggaccacggtccaccgtctcctcgacgcctaccaccgaacgggcccagtccggtccttccccctggtcccgtccctgtcccg

SEQ ID NO: 150282 - DNA, 631 bp, Homo sapiens
  misc_feature: GYAE6OF02G2VBY.43.57.F02.1.454.CMB.1.raw
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
tcagtgtgagtagtcacgaccggtgctcgatttagctcgatatagttgggtttggggggctgagcgtgcgttttcttgtggctattttaaaaggtgtccagtctgaggagcagctgttggagtctggggggaggcttgatacaggccgggggggtccctgagactctcctgtgtagcctctggattcacctttaacaactatgccatgacctgggtccgccaggctccgagggaagggctggagtgggtctcagtaataagtggaagtgctggtaccacactttangcagactccgtgatgggccggttnaccatctccagagaacaattccaagaacacgctgtgtctgacaaatgaacagcctagacgagccgaaagacgacggccgttatattactgtgacgagagggcgtcgggagagtacgattagttttgacgttggtttatttcgcgtccttaacgtactactacgtcgtttaggaccgtcgtggggaccaacgggcccgtacggtaccgacccgtctacccgtccgaaccgcccgttacccaacccgaacccgggtcccctaacgttcccgggtttacccttcccccccgtagggtcccccggtaccccgttccgtaccccgg

SEQ ID NO: 150283 - DNA, 558 bp, Homo sapiens
  misc_feature: GYAE6OF02I4GLW.43.57.F02.1.454.CMB.1.raw
  modified_base (217)..(217): a, c, t, g, unknown or other
  misc_feature (217)..(217): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccnccaggctccgagggaaggggctgggagtgggtctcagtaataagtggaagtgctggtaccacactttatgcagactccgtgatgggccggttcaccagtctccagagacaattccaagaacacgcngtgtctgacaaatgaaangcctgacgagccgaagacacggccgtatattacngtgcgagaggcgtcggagagtacgattatttgacttggttatttgcgtctacttactactacgtcttggacgtgtcggggccaagggaccacggtcaccgttcctctcacgcctccgacaacgggtcccagtcggtccttccccgtcggccgcccttgccccg

SEQ ID NO: 150284 - DNA, 571 bp, Homo sapiens
  misc_feature: GYAE6OF02FYA00.43.57.F02.1.454.CMB.1.raw
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccagggaaggggctggagtgggtctcagtaataagtggaagtgctggtaccactactttatgcagactccgtgatgggccggttcaccatctccagagacaattccaaagaacacgctgtgtctgacaaatcgaaacagcctgaagacgaccgaaagacacgggcctaatattactgtgcgagaggcgtcggagagtacgtattatttgacttggttatttgtcgctactactactacgtcgttgacgtcgtcgggaccaagggaccgacggtcaccgtctcctcacgcctaccaccgaacggcccacgtccgttccgttcccccgtcggcccgtcccgtcgtccg

SEQ ID NO: 150285 - DNA, 636 bp, Homo sapiens
  misc_feature: GYAE6OF02G13IH.43.57.F02.1.454.CMB.1.raw
  modified_base (284)..(284): a, c, t, g, unknown or other
  misc_feature (284)..(284): n is a, c, g, or t
tcagtgtgagtagtcacgaccggtgctcgatttagctcgatatagttgggtttggggggctgagcgtgcttttctgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccagggaaggggctggagtgggtctcagtaataagtggaagtgctggtaccactactttangcagacctcgtgatgggccggttcaccatctccagagacaattccaaagaacacgctgtgtctgacaaatgaaacagcctagacgagccgaaagacacggacgtatatactgtgacgagtaggcgtacggagagtacgattatttgattgttatttgcgtctactacttactacgtcgtttaggacgtgtcggggtaccgaaaggggtacccgtacgggtaccgtacccgtaccttcccgtaccgtaaccggtcccctacccgtaacccggaaaccggggtcccccgttaaccgtcccgggtttccccttttcccccccggacgggtcccccggtccccgtccggttccccg

SEQ ID NO: 150286 - DNA, 618 bp, Homo sapiens
  misc_feature: GYAE6OF02GS1OF.43.57.F02.1.454.CMB.1.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
tcagtgtgagtagtcacgaccggtgctcgatttagctcgatatagttgggtttggggggcgtgagcgtggcgtttctaggtggctattttaaaaggtgtccagtctgaggagcagctgttggagtcgtgggggaggcttgatacaggccggggggtccctgagactctcctgtgtagcctctggattcacctttaacaactatgccatgacctgggccnccaggctccgagggagggctggagtcgggctanagtaataagtggaagtgcgttggtacccacacttttatggacaaggcttccgtgagttgggcccggttacaccctatcctccaaggnaacattaccaaagaacaccggtntgtctcnacaatcgaancgtcngagacgacgaagacgtacgactatactngcgacgagaggcgtagagtagtactattgttagtagttgttagttcacgtactactactacgtacgtgttacggcgtcggacgggacctaacgggccctacggttacccgaccgttcctccgtacgaccgtacccgtaccgaacccggtaacggtccctacggttcccggttcccttccccggcggtccctacccgtcgtacccgg

SEQ ID NO: 150287 - DNA, 616 bp, Homo sapiens
  misc_feature: GYAE6OF02IFDAO.43.57.F02.1.454.CMB.1.raw
  modified_base (215)..(215): a, c, t, g, unknown or other
  misc_feature (215)..(215): n is a, c, g, or t
  modified_base (282)..(282): a, c, t, g, unknown or other
  misc_feature (282)..(282): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccggggggtccctgagactctcctgtgtagcctctggattcacctttaacaactatgccatgacctgggtccnccaggctccagggaagggctggagtgggtctcagtaataagtggaagtgctggtaccacacttttangcagactccgtgactgggccgttcaccatcctaccagagactaattccaaagaacacgctgtgtctgacaaaatgaacagcctagagacgaccgaaagccacggtcctaatacttacgtggtacgcgaggacgggcggtacggaagtaggtaacgatttattttgacgtttggttatttcgcgtacttaactacctaacgtacgtcgtttacggaccgtcgtacgggaccgaacgggaccgtacggtccaccgttcctccgtcacgtccctaccgacccgaacggcccctaacgttcccggtcccttcccccggcggtcccgtcccgtgtcccg

SEQ ID NO: 150288 - DNA, 608 bp, Homo sapiens
  misc_feature: GYAE6OF02F6A44.43.57.F02.1.454.CMB.1.raw
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
tcagtgtgagtagtcacgaccggtgctcgatttagctcgatatagttgggtttggggggctgagcgtgcgttttctagtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaaggggctgggagtgggtctcagtaataagtggaagtgcgtggtaccacactttatgcaagactccgtgagtgggccggttacaccatcctccagagaacaattccaaagaaccacgtctgtgtctagacaaatgaaacncgcctgaagacgaccgaagaccgacggtccgtataacgtttacngtgacgagaggcggtacgggaggaagtacgagttatttgtacttaggttatttggcgtacgtactactacgtacgtcgttaggtcgtcgtcgggtacgaacgggaccgtacggtcgaccgttctccgtctacggccctaccgaccgaacggccctagtcccgttccgttccccgaggtcccgtcctcgtcccg

SEQ ID NO: 150289 - DNA, 548 bp, Homo sapiens
  misc_feature: GYAE6OF02FIYB1.43.57.F02.1.454.CMB.1.raw
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtanatttacngtgcgagaggcgtcggaggagtacgatatttgacttggttatttgcgtctactactactacgtcttggacgtcgtggggccaagggaccacggtcaccgtctcctcacgccctccaccgacggcccagtccggtccttccccgtggccgccctgtcc

SEQ ID NO: 150290 - DNA, 548 bp, Homo sapiens
  misc_feature: GYAE6OF02FI0EG.43.57.F02.1.454.CMB.1.raw
  modified_base (356)..(356): a, c, t, g, unknown or other
  misc_feature (356)..(356): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacngcctgagagccgaagacacggcctatattactgtgcgagaggcgtcggagagtacgatatttgacttggttatttgcgtctactactactacgtcttggacgtcgtgggccaacgggccacggtcaccgtctcctcacgcctccaccgaacggcccagtccggtaccttcccccgtggccgtccctgtcccg

SEQ ID NO: 150291 - DNA, 587 bp, Homo sapiens
  misc_feature: GYAE6OF02FNMAP.43.57.F02.1.454.CMB.1.raw
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (582)..(582): a, c, t, g, unknown or other
  misc_feature (582)..(582): n is a, c, g, or t
tcagtgtgagtagtcacgaccggtgctcgatttagctcgatatagttgggtttggggggctgagcgtgcgtttctaggtggctaattttaaaaggtgtcagtctgaggagcagctgttggagtctgggggaggcttgatacagccgggggggtccctgagactctcctgtgtagcctctggattcacctttaaacaactatgccatgacctgggtccnccaggctccagggagggctggagtgggtctcagtaataagtggaagtgctggtaccacactttangcagtactccgtgatgggccgttcaccatctccagacgacaatccaaagacacgctgtgtctgcaaaatgaaacngacctggaagcgccgaaagactacggccgtaatacgttactggtcgcgagagggcggtacgggagtaggtacgattactttgacttggtttattgtcgtactactactacgttacgtcgttaggacgttgtcgggtaccgaaagggacctacggtcaccgttctctcacgtccctcctaccgaacgggtccctagttccggtccttccccgtaggcctcccgtntcccg

SEQ ID NO: 150292 - DNA, 566 bp, Homo sapiens
  misc_feature: GYAE6OF02FV3LZ.43.57.F02.1.454.CMB.1.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaaggggctggagtgggtctcagtaataagtggaagtgctggtaccactactttatgcagactccgtgatgggccgttcaccatctcagagacaattccaaagaacacgctgtgtctgcaaaatgaaacngcctgagagccgaagacacggctaatattacngtgcgagaggcgtacggagagtacgattatttgacttggttattgcgtctactactactacgtcttggtacgtcgtcggggaccgaacgggaccacggtcaccgtctcctcacgccctaccaccgaacggcccacgtccggttcccttcccccgtcggcccgtccctcgtcccg

SEQ ID NO: 150293 - DNA, 609 bp, Homo sapiens
  misc_feature: GYAE6OF02GY52S.43.57.F02.1.454.CMB.1.raw
  modified_base (292)..(292): a, c, t, g, unknown or other
  misc_feature (292)..(292): n is a, c, g, or t
  modified_base (548)..(548): a, c, t, g, unknown or other
  misc_feature (548)..(548): n is a, c, g, or t
tcagtgtgagtagtcacgaccggtgctcgatttagctcgatatagttgggtttgggggaggcttgatacagccgggggggtcccgtgagactctcctgtgtagcctctggattcacctttaacaactatgccatgacctgggtccgccaggctccagggaaggggctggagtgggtctcagtaataagtggaagtgctggtaccacactttatgcagactccgtgatgggccgttcaccatctccagagacaattccaaagaacacgctgtgtctgacaaatgaacagcccngagagccgaagacgacggccgtatattactgtgcggtagaggcggtcggagaggtacgattattttggactggtttatttgcgcttactactaactacgtcgttttggacgttcgtgggggtacccgaaagggacccgacggttccgacccgttcctccctcgacgccctcccaacccgaacgggccctacgtccggttcccttcccccgtcggcccgccctcgcctccgacggacgccacctccgagactcgacncggccgcccgtgggcctcggccttcggacgaacggtccttaacttcccactacctcaaccg

SEQ ID NO: 150294 - DNA, 783 bp, Homo sapiens
  misc_feature: GYAE6OF02IT9MR.43.57.F02.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
tcagtgtgagtagtcacgaccggtgctcgatttagctcgatatagttggggtttgggggctgagctggcttttctgtggctattttaaaaggtgtccagtctgaggagcagctgttggagtcgtgggggaggcttgatacaggccggggggtcctgagctctccgtgtgtagcctctggattccacctttaacaactntgccatgacctgggtccncagctcgagggaagggctggagtgggtctacgagtaataaggtggaagtcgtcgtcggtaccactactttagcgcagtacctccgtgagtcgggtccgttcacctatccgtacgaacggactaaccgtaacttaccgaaaacgaaccgtacgtctgtcgtctacgactaaagtacgacacgtacgtggaacgacgaccggaagaccgtaacggtacgttaatacgtttacgtgtacggagtaacggacgggtccggttaacggagttacggttaacgtaacgtttcgtttaacggtagttttacgggtttaattttccggacgttaacccgttaaactttaccgtaaacggtttccggtttaacgggtttaccggtaccggtttacggggacccggggtttaaccgaaacggggttcccgtaaaccggtttccgaaccccggtttccctaccggtaaccctaccggttcccctaacgggtaaacccggaccggttaccccgaaccggtttccccggttaccccggttttccccggtaccgggcccctttccccggacgttccccggg

SEQ ID NO: 150295 - DNA, 796 bp, Homo sapiens
  misc_feature: GYAE6OF02IEEM7.43.57.F02.1.454.CMB.1.raw
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
tcagtgtgagtagtcacgaccggtgctcgatttagctcgatatagttgggtttggggggctgagctggctttttctgtggctattttaaaaggtgtccagtctgaggagcagctgttggagtctgggggaggcttgatacgaggccggggggtccctgagactctcctgtgtagcctctggtattctaccttttaacaactatgccatcgacctcgggtcccgccagggctccgagggggaacggggctgggaggtgggtctacgaagtaaagtaaggtgggaagtggcgttacggtaccaacctactttatgactaacgctccggtgagtcggggccggtttaccacactcctaccgaagacgaactaattaccaaagaaccaccgntgtgttactagacaaagtacgaacncgtaccgtagacgaacggaaccggaaacgacccgtaacgggccttaaacgttaactttaccgttagggtacgtacggtagggaacgggtccggtacgggtaaggtaacgttacggtaagtttagttttacgtacgtttagggtttactttacgcgttaaccttaacgtaacccgttaacgttaccgttccggtttaacggttaccggttagggttaccggggaccgtaaaccggggaaccccgttaccgggtaccctaaccccgggttctaccccgttcgtacccgtccccgtaacccgaaccggtaaccccggtaccctaccggttccccggtttcccgtaccccccgggttccgggcccccgttcccgtccgtaaccccgg

SEQ ID NO: 150296 - DNA, 686 bp, Homo sapiens
  misc_feature: GYAE6OF02GK6DM.43.57.F02.1.454.CMB.1.raw
  modified_base (415)..(415): a, c, t, g, unknown or other
  misc_feature (415)..(415): n is a, c, g, or t
  modified_base (458)..(458): a, c, t, g, unknown or other
  misc_feature (458)..(458): n is a, c, g, or t
tcagtgtgagtagtcacgaccggtgctcgatttagctcgatatagttgggtttggggggctgagcgtgtcgtttctaggtggctatttaaaaggtgtccagtctgaggagcagctgttggagtcgtgggggaggcttgatacaggccggggggtccctgagactctcctgtgtagcctctggattcaacctttaacaactatgccatcgaccgtcgggccgccaggcctccgaggggaaggggctggagtgggtctcgaagtaataagtggaagtgctggtaccactacttttagcgacgagccgtcgtgagtcgggggtccgttaccaccgtacttccgccgaaggactaactaacttaccgaaagaaccacgtctgtcgtacctagacaaagtacgaacgagccttaaggaancggaacccgggaaataccgaaccggacgttaaatcgtttacgnggtacggacgtaggacggtcggtaggaagtagtagtaatttagtttacgtagttagttattcgtacgtacttacctactactacgttccgtttggacgttccggtacggaccggtaacggacccgtccggtacccgtccgtcctcctaccgtaccgtcccgtaccaacccggtaccggtaccctacggttcccgttccccgttccccgccggcccgtcccgacgtccg

SEQ ID NO: 150297 - DNA, 599 bp, Homo sapiens
  misc_feature: GYAE6OF02IQPS6.43.57.F02.1.454.CMB.1.raw
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
tcagtgtgagtagtcacgaccggtgctcgatttagctcgatatagttgggtttggggggctgagctggctttttcttgtggctattttaaaaaggtgtccagtctgaggagcagctgttggagtctgggggaggcttgatacaggccgggggggtccctgagactctcctgtgtagcctctggattcacctttaacaactatgccatgacctgggtcccgccaggctccgagggaagggctggagtgggtctcagtaataagtggaagtgctggtaccacactttangcagactccgtgagtgggccgttcaccatcctccgagacgactaactaccaagaacacgctgtntctgacaaatgaacagcctaggagacgaccgaaagaccgaccgggctaattacgttacctggtcgacggaaggaaggcgggtacggaaggtaagtacgtattagttttagacgtttggttatttgcgtacttactactactagtcgttgacgtcgtcggggcaacgggccacggtccaccgtcctcctcacgccctaccaccgaccggccctagtcccgtccttccccgcggacccgtccctcgtccg

SEQ ID NO: 150298 - DNA, 664 bp, Homo sapiens
  misc_feature: GYAE6OF02GM0GB.43.57.F02.1.454.CMB.1.raw
  modified_base (351)..(351): a, c, t, g, unknown or other
  misc_feature (351)..(351): n is a, c, g, or t
tcagtgtgagtagtcacgaccggtgctcgatttagctcgatatagttgggtttggggggctgagctggcttttcttgtggctattttaaaaaggtgtccagtctgaggagcagctgttggagtctgggggaggcttgatacaggccgggggggtccctgagactctcctgtgtagcctctggattcacctttaacaactatgccatgacctgggtccgccaggctccgagggaaggggctgggagtgggtctcgaagtaataaggtggaagtgctggtaccactactttatgcaagtacctccggtgagtcggggcccggttcaccatcctccagagacaatccaagaacncgctgtcgtctgacaaatgaacagcctagaagacgaccgaaagaccgacggtccgtaattacttacgtggtcgacggaggacgggcggtacggaaggtacggttacgtaatttagttttggacgtttaggtttatttcgcgtacttaactacctactacgtcgtttacggaccgttcggtacggggacccgaaagggtacccgtaccggtaccgacccgttctaccctccgacgtcccctacccgaaccgaaccgggtccctaacgttcccggttcccttcccccggtcgggtccccgtccccgtgtaccccg

SEQ ID NO: 150299 - DNA, 566 bp, Homo sapiens
  misc_feature: GYAE6OF02I78PW.43.57.F02.1.454.CMB.1.raw
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaaggggctggagtgggtctcgagtaataagtggaagtgctggtaccacactttatgcagactccgtgatgggccgttcaccatctccagagacaattccaagaacacgctgtgtctgcaaatgaacagcctgagagaccgaagacacggcctatattactgtgcgagaggcgtcggagagtacgatatttgacgtggttatttgcgtctactactactacgtctttggacgttcgtcgggccgaagggaccacggtaccaccgtcctcctcacgcctaccaccgaacggcccaacgtccggttccttcccccgtcggcccgtcccgtcgtacccgg

SEQ ID NO: 150300 - DNA, 602 bp, Homo sapiens
  misc_feature: GYAE6OF02F8V1R.43.57.F02.1.454.CMB.1.raw
  modified_base (535)..(535): a, c, t, g, unknown or other
  misc_feature (535)..(535): n is a, c, g, or t
  modified_base (596)..(596): a, c, t, g, unknown or other
  misc_feature (596)..(596): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctggggggaggcttgatacaggccggggggtccctgagactctcctgtgtagcctctggattcacctttaacaactatgccatgacctgggtccgccaggctccgagggaaggggctggagtgggtctcagtaataagtggaagtgctggtaccacacttttatcgcaagacctccggtgagtcgggccgttcaccatcctccagagacaatccaagacacgctgtgtctagacaaatcgaacagcctagagacgaccgaagaccgacggcctaatacttacgtggtgcgaggacggcggtagggaagaggtacgattagtttagactttggttatttcggcgtactacttactaactacgtcgtttaggcgttacgtcggggaccaacggggacctacggtcaccgttccncctcgacgtccctacccgacgacggtcccagttcccggtcccttccccgtggcccgtcccngtcccg

SEQ ID NO: 150301 - DNA, 593 bp, Homo sapiens
  misc_feature: GYAE6OF02GCA9D.43.57.F02.1.454.CMB.1.raw
  modified_base (398)..(398): a, c, t, g, unknown or other
  misc_feature (398)..(398): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgaggggaaggggctgggagtgggtctcagtaataaggtggaagtgctggtaccacactttatgcagactccgtgatgggccggttcaccatctccagagacaataccaaagaacacgctagtgtctgacaaatgaaacagcctagagagacgaagacacggctatattacngtgcgagacggcgtcggagagtacgtagttattttgacttggtttagttggtcgtactaactactacgtacgttcgttaggacgtcgtcgggaccgaacgggtaccacggtcctaccgtcctcctacgaccgcctaccaccgaaccgggtccctacgttcccggtcccttccccgcggcccgtcccgtcgtcccg

SEQ ID NO: 150302 - DNA, 624 bp, Homo sapiens
  misc_feature: GYAE6OF02G34T1.43.57.F02.1.454.CMB.1.raw
  modified_base (280)..(280): a, c, t, g, unknown or other
  misc_feature (280)..(280): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
tcagtgtgagtagtcacgaccggtgctcgatttagctcgatatagttgggtttggggggctgagctggcttttcttgtggctattttaaaaggtgtccagtctgaggagcagctgttggagtctgggggaggcttgatacagccggggggtccctgagactctcctgtgtagcctctggattcacctttaacaactatgccatgacctgggtccgccaggctccagggaagggctggagtggtctcagtaataagtggaagtgctggtaccatactttangcagactccgtgagtcgggccgttcaccatcgtccagacgaactaacttccaaagaaccacgctgtacgtctagacaaatgaaacacgtcctagagacgaccgaaagaccacggctatattacgngtgacgaggacggcggtacggagngtaacgtattatttgacgttgttattgtcgtctactactactacgtcgtttggacgtcggtacgggaccgtaacgggaccgacggtaccgtacccgtctacccgttcaccgtcccgttacccaacccgtaaccggggacccctaacggttcccggttacccgttcccccgtacgggcccgtcccgtccgtacccg

SEQ ID NO: 150303 - DNA, 614 bp, Homo sapiens
  misc_feature: GYAE6OF02GWMKQ.43.57.F02.1.454.CMB.1.raw
  modified_base (288)..(288): a, c, t, g, unknown or other
  misc_feature (288)..(288): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgagggaaggggctggagtgggtctcgaagtaataagtggaagtgctggtaccacactttangcagacctccgtgagtcggggccggttcacctatccgtccaagacgaacaacttccaaagaaccacgcttgtgtctagacaaatgaacagcctgaagacgaccgaaagacgacggtcctatacttactgtgcgaggcggcgtgggagagtacgattagttttgattggtttattgcgtactactactactacgtctttggacgtcgtggggaccaacgggtaccacggtccaccgtcctccgtacaccgtccctacccgaaccgaaccgggacccctaccggtcccggttcccttcccccggacggtcccgtccccgtagtccccg

SEQ ID NO: 150304 - DNA, 626 bp, Homo sapiens
  misc_feature: GYAE6OF02ICN63.43.57.F02.1.454.CMB.1.raw
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
  modified_base (619)..(619): a, c, t, g, unknown or other
  misc_feature (619)..(619): n is a, c, g, or t
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgcaggctccgagggaagggctggagtgggtctcagtaaataagtggaatgctggtaccacactttangacagacctcgtgatgggtccgttcacatctccagacgacaatccaagaacacgctagtcgtctgactaaaagtnaacacgcctagagacgacgaagacgaacggtctaatactacgtagtgagagaggtcggnggagtaggtaacgattaagtttgacgtttggtttattcgacgtacttaaccgtactacctacgttcgttacgggtaccgtcggtcggggacctaaacggggaccctacgggtaccaccggtctaccgtccgacggtcccgtacccgaaccgaaccggccctacgttccggttaccccttcccggtacggcccgttccccgtntacccgg

SEQ ID NO: 150305 - DNA, 586 bp, Homo sapiens
  misc_feature: GYAE6OF02HLAIK.43.57.F02.1.454.CMB.1.raw
  modified_base (342)..(342): a, c, t, g, unknown or other
  misc_feature (342)..(342): n is a, c, g, or t
  modified_base (580)..(580): a, c, t, g, unknown or other
  misc_feature (580)..(580): n is a, c, g, or t
tcagtgtgagtagtcacgaccggtgctcgatttagctcgatatagttgggtttgggggaggcttgatacagccgggggggtccctgagactctcctgtgtagcctctggattcacctttaacaactatgccatgacctgggtccgccaggctccagggaagggctggagtggtctcagtaataagtggaagtgctggtaccacactttatgcagactccgtgatgggccggttcaccatctccaagagaactaattccaaagaaccacgctgtgtctgacaaatgaacacgcctgagacgaccgaagacaccggccttataacttactgtagcgagacgggngacggagaagtacgtattagtttgacgttgtttattcgcgtacgttaactactaactccgtcgtttaggaccgttcgtgggaccgaacgggaccgtacggtccaccgtctcctcacgcctccaccgacggccctagtccgttcctcccgtcgccgtcctcgtcaccgagacgccaccgtcgacgcgaccacgacgcgccgtggcctcgtccgtcgacgacgtactaccttccactacnctaacg

SEQ ID NO: 150306 - DNA, 753 bp, Homo sapiens
  misc_feature: GYAE6OF02JT51K.43.57.F02.1.454.CMB.1.raw
tcagtgtgagtagtcacgaccggtgctcgatttagctcgatatagttgggtttggggggctgagctggctttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgccaggctccgagggaggggctggagtggctcagtaatagtggagtgctggaccactactttagtcgcacgtaccgtccggtgtacggtcgggtccgttaccaccgtactccgtacgaagactaactacttaaccaaagacctaccgtcgtgttcggtcacgactaaagacgaacgacggtacctaggacggacgaaccggaaacgaccgaccggtaacttagttacgttacgtgtacgtaacggagggtacggtacgggtacggtaaacggtaacgttaacgtattttaggtttacgtagtttacgggtttcgttacgtacgtaccttaaccgttacttaaccggtactttcgggttacgggtaaccgggttaccgggtaaccggggtaaccggtaaccggggtacccgtacgtaccccgtaccgttccctccgtaaccgcccgtaaccccgtaaccggaaccgggtaacccgtcccgttacccgttacccggttccccgacccgtcccgggtaccccgccgtacccggtacccgg

SEQ ID NO: 150307 - DNA, 797 bp, Homo sapiens
  misc_feature: GYAE6OF02GOAS0.43.57.F02.1.454.CMB.1.raw
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
  modified_base (455)..(456): a, c, t, g, unknown or other
  misc_feature (455)..(456): n is a, c, g, or t
  modified_base (506)..(506): a, c, t, g, unknown or other
  misc_feature (506)..(506): n is a, c, g, or t
tcagtgtgagtagtcacgaccggtgctcgatttagctcgatatagttggggtttgggggctgagctggctttttcttgtggctattttaaaaggtgtccagtctgaggagcagctgttggagtcgtgggggaggcttgatacaggccggggggtcctgagactcctcctgtgtagcctctggattcacctttaacaactatcgaccatcgacctgggtcccgccaggcctccgaggggaacgggctgggaggtcggtctacaagtaagtaaggtcgggaaagttgccgttaggtaacccacgtacgttttaancggactaaggtaccttccgtggtaacgtcgggggtaccccggtttccaaaccctnttacccgtaccaagggtaaacctaacctaaaccttacgaaaacggaaccacgttctcgttcgtactcaaacgttaaactggaaaccnnccgtagacggaacggcgaaacgaccgtacggaccttattacgtttaccgnggtacggaacgaggtacggtacgggtacggtaagtaacgtacgttaagtttaacggttcggtaacgttaggtttacgttacgtaccttaccgttaacgttaccttaaccgtacggttaccggttacggtaccgtacgggttacccgggaaccgggtaaccggtaacccgtaccggttacccgtaccgttcccgtactacccgtacccgtacccgtacccgaacccgggtcccgtaccgtacccggttaccccgttccccgtaccccgtcggtaccccgtcccgacgtcccg

SEQ ID NO: 150308 - DNA, 775 bp, Homo sapiens
  misc_feature: GYAE6OF02F185U.43.57.F02.1.454.CMB.1.raw
  modified_base (698)..(698): a, c, t, g, unknown or other
  misc_feature (698)..(698): n is a, c, g, or t
  modified_base (708)..(708): a, c, t, g, unknown or other
  misc_feature (708)..(708): n is a, c, g, or t
tcagtgtgagtagtcacgaccggtgctcgatttagctcgatatagttggggtttgggggctgagctggctttttcttgtggtctatttaaaaggtgtccagtctgaggagcagctgttggagtcgtgggggagcttgatacaggcccggggggtcctgagacgttctcctggtgtacgccttcgtggtattacaacctttaaacgaacttagtcgcctatcgaccgtcgggtcccggccgaggcctccgagggtacgggctggagtcggtctcgaagtaataagtggaagtcgtcttagaaccctataaccttttagcgtacgacgtacccgttcggttacgacgttacggggtcccggttaccaacccgttacgtccgttaccgaaacgtaagtaaacccgttaactttacccgaaaacgtaaaccgtacgtccgttaagttcggtacttagaacctaaagtcgaaacgtcgtaccgtaggtagaaccggaccggtaaacgaaccgtaccggtaccggtttaatacttaccggtgtacggacggtaacggacggtcggtaacggaggttaacgtacgtaatttaggtttcgaaacgtttaggtttattcgacttactaacctattaccgttcgttaggttacgtacgtcgggaacggtcccgaaaggtcccgacgttcccgacctcccgtacgtacnccggtacccnccggtaaccccggacggtccctaaggtccccgttaccctccccggtacgtccctccggtccgtaccg

SEQ ID NO: 150309 - DNA, 706 bp, Homo sapiens
  misc_feature: GYAE6OF02JBUM1.43.57.F02.1.454.CMB.1.raw
  modified_base (287)..(287): a, c, t, g, unknown or other
  misc_feature (287)..(287): n is a, c, g, or t
  modified_base (387)..(387): a, c, t, g, unknown or other
  misc_feature (387)..(387): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagtgtgagtagtcacgaccggtgctcgatttagctcgatatagttgggtttggggggctgagcgtggcttttcttgtggctattttaaaaggtgtccagtctgaggagcagctgttggagtctggggaggcttgatacagccgggggggtccctgagactctcctgtgtagcctctggattcacctttaacaactatgccatcgacctgggtccgccaggcctccgagggaagggctggagtgggtctcgagtaatagtggaagtgctggtaccacgtactttangcagaccttccgtagagtcgggcccggtttacaccgtattccgtaccaggtagaacctaattaccaaaggaacacgctgtgtctagactaaatgaaacgngtccgtagagacgaccgaaagccacgggactatacgttacgngtacgngtaacggnggtccggtaagaggacgttaacggtattacgttttagactttagggtttagttacgtcgtacgttaacttaccgttaaccgttacgttccgtttacgggaccggtttacgggccggggtaccgaaacggggaccctacgggttccctaccgttccgtttcccgacgaccggtccccttaacccgaacccggaaccgggtccctaacggtttccccggtttccccgttacccccggtcggccccggttacccctggtaccccgg

SEQ ID NO: 150310 - DNA, 857 bp, Homo sapiens
  misc_feature: GYAE6OF02JFQKZ.43.57.F02.1.454.CMB.1.raw
  modified_base (230)..(230): a, c, t, g, unknown or other
  misc_feature (230)..(230): n is a, c, g, or t
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
tcagtgtgagtagtcacgaccggtgctcgatttagctcgatatagttgggtttggggggctgagctggtcttttcttgtggctattttaaaaggtgtccagtctgaggagcagctgttggagtctgggggaggcttgatacagggcccgggggggtccctgagactctccgtgtgtagtcctctggattcctaacctttaacaaactatgccatcgtaccgtgggtcccnccgaggctccgaaggggaagggcgtggaggtcgggtctagtaagtaaattaggtggaagtcgcgttaggtaacccattaacttttgcgactacgaaccgtcgtagacggttcggggtcccgttccaaccgtntcccgtacgaaggtaacgaactaaactaaccgaaagaaacccnccggtcttgtacgttcgtaaggacctaaaatacggaaaccgtacggaccgttaggaacgggaacgtaaacccgggaaacgacccggtaacggtaccgtttaaacttaagtttaccggttggtccgaagggtacgggtacgggtacgggtacggggaaggtaaacgttaacgtaagtttaacggttttacggtaacgttttagggtttaacgtttccggtccgtttacccgttaaaccgttttaacctaaccggtttccggttaccggtttaacgggttcggttaccgggtacgggtaaacccgggaccgggtaaaccgtaccgggttaacctccccggttccttacccggacgttacccgaccccgtaccgaacccggtaaccggttcccgaaccgtttccccggttacccccgtttccccggaccggtccccgtcccggtaccgttccccg

SEQ ID NO: 150311 - DNA, 933 bp, Homo sapiens
  misc_feature: GYAE6OF02JU8T0.43.57.F02.1.454.CMB.1.raw
  modified_base (142)..(142): a, c, t, g, unknown or other
  misc_feature (142)..(142): n is a, c, g, or t
  modified_base (399)..(399): a, c, t, g, unknown or other
  misc_feature (399)..(399): n is a, c, g, or t
tcagtgtgagtagtcacgaccggtgctcgatttagctcgatatagttgggtttggggggctgagcgtggcttttcttgtggctattttaaaggtgtccagtctgaggagcagctgttggagtctgggggaggcttgatacgnggcccggggggggtccctggacgactctccctgtgtacgccgtctcggattcctaacccttttaaaccaaacttactcggaccctaagttcggaacccgtcggggtcccgacccggagggtccctacccggaagggggaaacggggcgttacgggtagggtttcggggtccttaccggaaggttaaaagttaacgggttacggggtaaaaggttcggtcgttacgggttaacccctaacgttaacctttttaacggngacccgtaaggaccccgttccggttaggacgtttccgggggacccggtttcccaacccgtacgttccgtaccccgaagtaacgtaaaccgtaccttaacccgaaagggtaaccccaacgaccgttggttcgtaccgttaggaacctaaaacgttcgaaacgtaccgacccggtttaaggacgaaacccggttaaccggaaccggtaaaccggtaacccgggttcccgttaaagtttaaaaccgtcgttttacgggcggtaacccgaagggttacgggaccgggtaccgggtacggtaacggtacgttaattacgttttacgtacggtttaggtttacgtttacgtaccgttacgttaccttacgtaaccgttccgttagtttcggacggttacggtaccgggtacgtaacccggtacggaccgttccgtaacgttcctacccgtcgtacccgccgtacccgaccgtacccgggtaccctacggttccccggtttcccgtccccgtacgggtcccgttcccggtacccgtcccgg

SEQ ID NO: 150312 - DNA, 677 bp, Homo sapiens
  misc_feature: GYAE6OF02IB47S.43.57.F02.1.454.CMB.1.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (411)..(411): a, c, t, g, unknown or other
  misc_feature (411)..(411): n is a, c, g, or t
  modified_base (549)..(549): a, c, t, g, unknown or other
  misc_feature (549)..(549): n is a, c, g, or t
  modified_base (603)..(603): a, c, t, g, unknown or other
  misc_feature (603)..(603): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggagcttgatacaggccggggggtccctgagactctcctgtgtagcctctggattcacctttaacaactatgccatcgacctgggtcccncaggctccgagggaagggctggagtgggtctacagtaataaggtggaagtgcgtaggtaccactacttttangacagtactccgtgaatggggtcccggttcacagttcctaccagaacgacctaattcccgaaaagaaccaccgcgttagttcgtcgtacgaactaaaagtcgaaactggaccgtaggaacgngaaccgaaacgtacgaccgggtacccttaattacgttaaccgtggtacgacgggtaaacggcgggtcggtaacgggaggtaacggttaacgaatttaagtttgtacgttagggtttattgcgtactactactatcgtntttacggacgtcgtcggggaccaacgggccgtacggtaccgtaccgtcctaccncgtacggtccctaccgaaccgaccggtaccctacgttccgtacccttccccggaggccccgtaccgtgtccccg

SEQ ID NO: 150313 - DNA, 605 bp, Homo sapiens
  misc_feature: GYAE6OF02FI0FZ.43.57.F02.1.454.CMB.1.raw
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (509)..(509): a, c, t, g, unknown or other
  misc_feature (509)..(509): n is a, c, g, or t
tcagtgtgagtagtcacgaccggtgctcgatttagctcgatatagttgggtttgggggaggcttgatacagccgggggggtccctgagactctcctgtgtagcctctggattcacctttaacaactatgccatgacctgggtcccgccaggctccagggaaggggctggagtgggtctcagtaataagtggaatgctggtacccacacttttatgcagactccgtgatgggcccggtttcaccatcctccagagacaatttccaaagaaccacgctgtgtctgacaaatgaaccagcctgagagccgaagacacggcctatattactgtgcgagaggcgtcggagagtacgattattttgacttggtttatttgcgtcttactactactacgtctttcggacgtcgtcggggaccaacgggaccgacggtccaccgtctccctcncgccctccgaccgacggacccncgtccgtcccttccccgtggcccgtccctgcctccgaggacncctacccgtccgacgacgccacgcggcccggtcccgtcgggctccggccgttggtaccgaacggtaccttaccgttacccacttacctcctaaccg

SEQ ID NO: 150314 - DNA, 578 bp, Homo sapiens
  misc_feature: GYAE6OF02F33KG.43.57.F02.1.454.CMB.1.raw
  modified_base (298)..(298): a, c, t, g, unknown or other
  misc_feature (298)..(298): n is a, c, g, or t
  modified_base (474)..(474): a, c, t, g, unknown or other
  misc_feature (474)..(474): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacagccgggggggtccctgagactctcctgtgtagcctctggattcacctttaacaactatgccatgacctgggtccgccaggctccgagggaagggctggagtgggtctcagtaataaggtggaagtgctggtaccacacttttatgcagactccggtnagtcgggccggttcaccatcctccagagacaattccaaagaccacgcttgtgtctgcaaatgaacagcctgacgagaccgaagacgacggccgtaatacgttactgtgagtaggaggcgtacggagagtacgtattatttgacttggttatttcgcgtactactactacgtacgtnttaggtacgtgtagggccgaacggaccacggtcaccgtctaccncacgcccnccgaccgacggtccacgttccggttcccttccccgtggcccgtcctctcccg

SEQ ID NO: 150315 - DNA, 691 bp, Homo sapiens
  misc_feature: GYAE6OF02IKMK3.43.57.F02.1.454.CMB.1.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
tcagtgtgagtagtcacgaccggtgctcgatttagctcgatatagttgggtttgggggctgagctggctttttcttgtggctattttaaaaggtgtccagtctgaggagcagctgttggagtctgggggaggcttgatacaggccggggggtccctgagactctcctgtgtagcctctggattcacctttaacaactatgccatgacctgggtccgccaggctaccgagggaagggctggagtggtctacagtaataaggtggaagtgctcggtaccactactttangcagactcgngagtcgggtccgttnacctactctccgaganaactactaccgaagaacncgtctgtcgtcgtgactaaagtcgaaacngccgtagaagtacgacgaagtaccgacggtaccttaatacttacgtgtacgcggaagtacgggcggtacggagtaagtaacgtacgtttagtttacgtacgtttaggtttacttttggcttacttaacgtaccgttaacggttaccgttcgtttaacggtaccggtccggtacggggaccgtaacgggacccgtaccggtaccgtacccgttccctccgtaccgaccggtccctaccggaacccggtaaccggtccctaaccggtttcccggttaccccttcccccggtcggtacccctccccgttacgtaccccg

SEQ ID NO: 150316 - DNA, 835 bp, Homo sapiens
  misc_feature: GYAE6OF02IZBQX.43.57.F02.1.454.CMB.1.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagtgtgagtagtcacgaccggtgctcgatttagctcgatatagttgggtttggggggctgagctggcttttcttgtggctattttaaaaggtgtccagtctgaggagcagctgttggagtctgggggaggcttgatacaggccggggggtcctgagactctcctgtgtagcctctaggattcaacctttaacaactatgccatgacctgggtccnccagctccgagggagggctggngtaggtctacgaagtaataaggtggaagtgctacggtaaccacgtacttttgagacagaccttccgagtacggtacgggtcccgttacacctatcctaccgagaacgtaacctaattaccgaaacggaaccagtcctagttctcgtacgaactaaagtacggaacacgtacctgaacgacgaacgaagaaccggacgacgttattaagttaccgtggtacggacgtaaggtacgggtacggtagggtaacgaacggttaacggtattttaacggttttacggtaacggttttaacggtttacgttttacgggaccttaccgttaacccgttaaccgtaaacggttaccgggtttccgtttaacgggtccggtttaccgggtaccgggggtaaccgaaacggggttacccggaaccggtttacccgtaacccgttcccgttacccgaccgttaaaccccgggtcccctttaaacccggaacccgggttaaaccccgggtccccgttaacccgggttttaccccccggtttaccccgtttaacccccccgggtaccggggtaacccccggtttcccgggtacccggttaacccccggg

SEQ ID NO: 150317 - DNA, 668 bp, Homo sapiens
  misc_feature: GYAE6OF02HO7IK.43.57.F02.1.454.CMB.1.raw
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
tcagtgtgagtagtcacgaccggtgctcgatttagctcgatatagttgggtttggggggctgagctggcttttcttgtggctattttaaaaggtgtccagtctgaggagcagctgttggagtcgtgggggaggcttgatacaggccgggggggtccctgagactctcctgtgtagcctctggattcacctttaacaactatgccatgacctgggtccgccaggctccgagggagggctggagtggtctcagtaatagtggaagtgcgtaggtaccacgtactttagagacagacttccgtagtacgtcgggtcccggttacacccatcctccgaagacgactaacttaccaaagaacncgctgtcgtctagacaaaatgaacacgcctagacgacgacggaacgacaaccggtctaatcgtttaacnggtcgacggagtacgggaggtcgggaagtacggtaacgttaacttattttaggacgtttacggtttagtttcgacgtacctaacgttaaccttacgtacgttccgtttacggacggttcggtacggggtaccgaagggtacccgacggcctacgtccaccctacgccgtcctacccaacgtaccggaccctaccggtcccggttcccttaccccggtcggtacccgtcccgtaccgtcccg

SEQ ID NO: 150318 - DNA, 660 bp, Homo sapiens
  misc_feature: GYAE6OF02FQVE9.43.57.F02.1.454.CMB.1.raw
tcagtgtgagtagtcacgaccggtgctcgatttagctcgatatagttgggtttgggggggctgagctggctttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccgaggggaggggctggagtgggtctcagtaataggtggaagtgcgtggtaccactactttatgcagacctccgtgagtggggcccgttcaccatcctccagagacaataccaagaacacgctgtgtctgacaaatagaacagcctagagacgaccggaaagaccgacggaccttaattacgtttacgtggtacggacggaaggacgggtcgtacgggaaggtacgtaacgtatttagttttacgacgtttaggtttatttcggaccgtacttaacttacttacgtacgttcgtttacgggacgttcggtcggggaccgaacgggaccctacgggtcctacccgttcctccctcgaccgtccctacccgaaccggaaccggtccctacgttcccggttcccctttccccggcgggtcccgtccccgtcgtcccg

SEQ ID NO: 150319 - DNA, 710 bp, Homo sapiens
  misc_feature: GYAE6OF02H8VZR.43.57.F02.1.454.CMB.1.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (379)..(379): a, c, t, g, unknown or other
  misc_feature (379)..(379): n is a, c, g, or t
tcagtgtgagtagtcacgaccggtgctcgatttagctcgatatagttgggtttgggggggctgagctggctttttcttgtggctattttaaaaaggtgtccagtctgaggagcagctgttggagtctgggggagcttgatacaggccggggggtccctgagactctcctgtgtagcctctggattcacctttaacaactatgccatgacctgggtccgccgaggctccgaggggagggcgtggaggtgggtctcgaagtaataagtggtaagtgctggtaccactactttagngcagactccgtgagtcgggccgttacactactcnccgagagactactacaacgacacgtctagttgtactgactaaatcgaaacanccgagagacgacgaacgaccgacggaccttagtacttaacgttggtacgacggaggacggtcgggtacggaacggttaacggtaacgtaagtttacgttttagttaaacgtttgggttttaacgtttcggtaccgttaccttaaccgttaacttaccgttacggtttccgtttagggtccgttaccggttacgggacccgtaaagggacccgtacggaccgttacccgtcttacccgtcctacgtacccctcccgaacccgtaaaccgggccccgttcggttacccggttcccccttccccggcccggttccgtccccggtcgtaccccgg

SEQ ID NO: 150320 - DNA, 600 bp, Homo sapiens
  misc_feature: GYAE6OF02FLBSU.43.57.F02.1.454.CMB.1.raw
  modified_base (323)..(323): a, c, t, g, unknown or other
  misc_feature (323)..(323): n is a, c, g, or t
tcagtgtgagtagtcacgaccggtgctcgatttagctcgatatagttgggtttgggggaggcttgatacagccggggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccgttcaccatcctccagagacaattccaagaacacgctgtgtctgacaaatgaaacagcctagagagccgaagaccacggccgtatattacnggtgcgagaggcgtacggagacgtacgattagtttgacttggtttattgcgtctactactactacgtctttggacgttcgtggggaccaacgggaccacggtccaccgtcctcctcgactccctccacgacggccctacgttccgttcccttccccgtcggcccgtcccgtcgccctaccgacggacgccgacccgtccgacgacgccacgacgccggaccgtcgggcctcgccgtcggtacgaacggtacctaccgttccacctacctacctaacg

SEQ ID NO: 150321 - DNA, 754 bp, Homo sapiens
  misc_feature: GYAE6OF02F0ID2.43.57.F02.1.454.CMB.1.raw
  modified_base (233)..(233): a, c, t, g, unknown or other
  misc_feature (233)..(233): n is a, c, g, or t
  modified_base (676)..(676): a, c, t, g, unknown or other
  misc_feature (676)..(676): n is a, c, g, or t
tcagtgtgagtagtcacgaccggtgctcgatttagctcgatatagttggggtttggggggctgagctggctttttcttgtggctaattttaaaaggtgtccagtctgaggagcagctgttggagtcgtggggggagtcttgatacaggcccgggggggtccctgagactcctcctgtgtagcctcgtggattccaacctttaacaactatcgaccatcgaccgttcgggtccnccgaggcctaccggaaggggaacggggtcttgggaggttcgggtctacgtaaggttaagtaaggttaggaacgttgcgttacggtacctacttactttagcgactacggtacgttccgtagtacggttccggggccttacaccttagtaccgtaccgaagactactaaacctaccaaacggaaccgtaccgtgttaccgtagtccctacgaataaacgtacggaaactacgcgtaggaacggacgaccggaaaacgtccgtacccgggactttaagtactttcggacggaggacgtaacggtggtaccggaccggtaagtaacgtacggtttattaacgtttaggtacgttttaggttattccgtacgttactaccttaaccgtacgttcggttcgttacggtccgttacggtaggaacccggaacgtccggacgtacccgtntcctccgactcccgacctaccgaccgaccggtccttaccgtccggttccccctaccgggccgcccgttccaccgtcgg

SEQ ID NO: 150322 - DNA, 371 bp, Homo sapiens
  misc_feature: GYAE6OF01C7TQ1.48.38.D05.1.454.CMB.1.raw
  modified_base (327)..(327): a, c, t, g, unknown or other
  misc_feature (327)..(327): n is a, c, g, or t
  modified_base (362)..(371): a, c, t, g, unknown or other
  misc_feature (362)..(371): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtccttcccctggcaccctcctccaagagcacctctgggggcacagcggccctgggctgcctggtcaaggctacttccnctctcgactctgagcgggctggcaaggcgcatagnnnnnnnnnn

SEQ ID NO: 150323 - DNA, 544 bp, Homo sapiens
  misc_feature: GYAE6OF01EO0TS.48.38.D05.1.454.CMB.1.raw
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggttttgatcagcagaagtcaggccaggcccaagactgctcatcgtatagagacagtgagaggtcctcgagggatccctgagcgattctctggctccgagctcgtgggacacactcactctgactatcagtgaagtcgganaagaagacgaggctagactactattgtacagtcaagganaacaatactcgacacgactaagttacgtggttccggacgggaacgggtaccgaacggtcgtaggaaccgaggttacccgtaagggtaccaacggacccgaaagggtccctccggtaccccccg

SEQ ID NO: 150324 - DNA, 362 bp, Homo sapiens
  misc_feature: GYAE6OF01CMTIG.48.38.D05.1.454.CMB.1.raw
  modified_base (354)..(362): a, c, t, g, unknown or other
  misc_feature (354)..(362): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtctcccctggcaccctcctccagagcacctctggggcacagcggccctggctgcctgtcaaggctactcctctctcgactctgagcggctggcaaggcgcatagnnnnnnnnn

SEQ ID NO: 150325 - DNA, 517 bp, Homo sapiens
  misc_feature: GYAE6OF01EV2PM.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggcccaagactgctcatgtatagagacagtgagaggtcctcagggatccctgagcggattcgcagggctccagtcgtctggacgacactcactctgactatcagtgaacgtcgggcagaagacgaggctgactactatgtcagtcaggagacaatactcgcacgcaaggtactggttcggacgggaggaccgaaggctagaccgtagtccctagggtccacgaccccgaaggccctcggtccccccg

SEQ ID NO: 150326 - DNA, 513 bp, Homo sapiens
  misc_feature: GYAE6OF01ANUJH.48.38.D05.1.454.CMB.1.raw
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggttttgatcagcagaagtcaggccaggcccaagactgctcatgtatagagacagtgagaggtcctgagggatcccgtgagcgattctctggctccgagctcgtgggacacgactcactctgactatcagtgaacgtccggnagaagcgaggctagactatatgcagtcagganacaatacctcgacacgactaacgtctggttcggacggagggaccaaggctaggacacgttccaaggtccacggacccaaggtcctcccggtacccccg

SEQ ID NO: 150327 - DNA, 723 bp, Homo sapiens
  misc_feature: GYAE6OF01CM0OL.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctcccctcctcattctctgcacaggctctgaggcctcctatgaactgacacagccaccctcggtgtcagtcgtccccaggacagacggccaggatcacgtgctctgcagagacgttgccaagtcaattttggttttggatcagcagaagtcaggccaggcccaagactgctcatgtatagagacagtgagaggtcctcgagggactcccgtggacgcgaactttcgtctgggtcctacccgtagtcctcgtacggggaccaaccaccttcctaaccttcgtagtaactacttaccgaggttaaaaacggacggttacccggggaactaaacgggaaacggaaccgggaggtaccgttacggtaaaccgtttaaccgttaagtttacggttaccgtaaggttaccgaaacgggtaacgtaaaccgtaaacgtttaacccgtaccggaacccgtaaccggtaaccgtaaacgggttacccgttaggggtttacccggggaaccgggggaacgggtaaacccgaaacggtacgtaacggaccgtaacggttacccgttaacgggtaccgaaccggaccccgaaacgggtccccgttacccggtaccccccgg

SEQ ID NO: 150328 - DNA, 367 bp, Homo sapiens
  misc_feature: GYAE6OF01AYA8C.48.38.D05.1.454.CMB.1.raw
  modified_base (362)..(367): a, c, t, g, unknown or other
  misc_feature (362)..(367): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggaaccacctctcttgcagcctccaccaagggcccatcggtcttccccctggcaccctcctccaagagcacctctgggggcacagcggccctgggctgcctggtcaaggctacttcctatgtatactctgagcgggctggcaaggcgcatagnnnnnn

SEQ ID NO: 150329 - DNA, 557 bp, Homo sapiens
  misc_feature: GYAE6OF01BLDCJ.48.38.D05.1.454.CMB.1.raw
  modified_base (399)..(399): a, c, t, g, unknown or other
  misc_feature (399)..(399): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaatttggtttttggatcagcagaagtcaggccaggcccaagactgctcatgtatagagacaggtgagaggtcctcgagggactccctggacgcgtattcgtcgtcgggctccgagtctcgtagggacacactcactctgactatcagtgaacgtccggganaggaagacgaggctagactacgttattcgtcagtcgaaggagacaatacgtcgacaacgacaaggtactcggtccggacgggaacgggacccaaggtctaggaacctaggtaccctaggggtaccacggtacccccgaaggccgtcccgtccccccgg

SEQ ID NO: 150330 - DNA, 520 bp, Homo sapiens
  misc_feature: GYAE6OF01CYPUW.48.38.D05.1.454.CMB.1.raw
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtcgtccccaggacagacggccaggatcacgtgctctgcagagacgttgccaagtctaattttggtttttggatcagcagaagtcaggccaggcccaagactgctcatgtatagagacagtgagaggtcctcgagggatcccgtgacgcgaatttctcgtggctccgagcttcgtggggacacactcactctgactatcagtagaagtccggganagaagacgaggctgacttacattgtcagtcagggaanacaatactcgcacgacgagtacgtggttacggnggacgggaccaaggctagacagtcctaggtcaacgcccaaggcctcgtcccccg

SEQ ID NO: 150331 - DNA, 646 bp, Homo sapiens
  misc_feature: GYAE6OF01BZH1Z.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtcgtccccaggacagacggccaggatcacgtgctctgcagagacgttgccaagtctaagttttggttttgatcagcagaatcaggccaggcccaagactgctcatgtatagagacagtgagaggtcctagagggactcccgtaggacgcgatttccgtcgtcggcctaccgagtccttcggtacgggaaccgacctacgttcaaccttccgtagtaaccttagtcgaaggttacgtaacggttacccggggacaaagggaaacggaaccgggtaacggtacgttacgtaaccgtttaacgttagtttacggttactaaggtacgaaggtaacgaacgtaaactaccgtacgaccgaacgacgtaacggtacgtcggttaccgggacggtaacggggaccaacggactacggaccgacgttacccgtaggtaccgacgacccgaaggtcccgtaccgtcccccgg

SEQ ID NO: 150332 - DNA, 513 bp, Homo sapiens
  misc_feature: GYAE6OF01B2KK3.48.38.D05.1.454.CMB.1.raw
  modified_base (322)..(322): a, c, t, g, unknown or other
  misc_feature (322)..(322): n is a, c, g, or t
  modified_base (387)..(387): a, c, t, g, unknown or other
  misc_feature (387)..(387): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttgatcagcagaagtcaggccaggcccaagactgctcatgtatagagacagtgagaggtcctgagggactcccgngagcgattctcgtggctccagtcctgtgggacacactcactctgactatcagtagaggtccgggnaaggaagacgaggctgactactattgtacagtcaggaagacaagtactcgacacgacaacgtactggtacggcggaaggaccagctaggacacgtcctaggtcacgacccgaggcctcgtcccccg

SEQ ID NO: 150333 - DNA, 527 bp, Homo sapiens
  misc_feature: GYAE6OF01DCX6Y.48.38.D05.1.454.CMB.1.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaatttggtttttggtatcagcagaagtcaggccaggcccaagactgctcatgtatagagacagtgagaggtcctcgagggatccctgagcgattctctggctccagctcgtgggacacactcactctgactatcagtgaagtccgggacagaagacgaggctgactactnttgtnagtcagganaacaatacgtcgcacgactaagtacgttggttacgggacgggtagggaccaagccgttaggaacacggttcctagggtccaacggacccaaggcctcggaccccg

SEQ ID NO: 150334 - DNA, 365 bp, Homo sapiens
  misc_feature: GYAE6OF01BDIY0.48.38.D05.1.454.CMB.1.raw
  modified_base (361)..(365): a, c, t, g, unknown or other
  misc_feature (361)..(365): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttcccctggcaccctcctccaagagcacctctgggggcacagcggccctgggctgcctggtcaaggctacttcctctctcgactctgagcgggctggcaaggcgcatagnnnnn

SEQ ID NO: 150335 - DNA, 393 bp, Homo sapiens
  misc_feature: GYAE6OF01EFM7K.48.38.D05.1.454.CMB.1.raw
  modified_base (383)..(393): a, c, t, g, unknown or other
  misc_feature (383)..(393): n is a, c, g, or t
tcagagtatacatacacgaccggtgctcgatttagtatctgatagttgggtttggggcaggggagggggctaaggtgaggcaggtggcgccagccaggtgcacacccaatgcccatgagcccagacactggacgctgaacctcgcggacagttaagaacccaggggcctctgcgccctggcccagctctcgtcccacaccgcggtcacatcggcaccacctctcttgcagcctccaccgaacggcccagtccggtccttcccccgtggccaccctcctccaagacgccacctcgtgggggcacgagccggcccgtgggcctcggcctggtccaaggtactacttcctatgtatacgtctgagcggctggacaaggcgcatagnnnnnnnnnnn

SEQ ID NO: 150336 - DNA, 561 bp, Homo sapiens
  misc_feature: GYAE6OF01D9CE8.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaattttggttttgatcagcagaagtcaggccaggcccaagactgctcatgtatagagacagtgagaggtcctcgagggactcccgtgagcgtattctcgtcggctccgagtctcgtgggacacactcactctagactatcaggtgaacggtccgggacaaggaacgacggagctagtactactagttcgtacagtacgaaggacaactaataccgtgaccacgacgacgttacgtcggtcgggacgggaacgggaccgaaacggcgtacggacgtacggtaccgtacggtaccacgacccgaacggtccgtcccgtcccccg

SEQ ID NO: 150337 - DNA, 691 bp, Homo sapiens
  misc_feature: GYAE6OF01DAXYZ.48.38.D05.1.454.CMB.1.raw
  modified_base (261)..(261): a, c, t, g, unknown or other
  misc_feature (261)..(261): n is a, c, g, or t
  modified_base (485)..(485): a, c, t, g, unknown or other
  misc_feature (485)..(485): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaattttgggtttttggtatcgangaagtacgtacgacgaccgacccgaaccgaagtacgtgtcctatagtagtaagtaggacgagtagaggaggtacgtccgtaggaggtacctccgtaggacgtacgttacttccgtcggtcggtccctaccgtacgtcgttcgggacgggaaccaccgtaccacctacttcgacgtacttacacgtaggtaacggtaccgggtccgaagaaggaaacgtacgggngtacgtaactaacccttaagttgttcgtagtacgtaggaagggaactaacttaaacgtccgtccgaaccgtacgtaacgttaacgttcgggttaccgggtaccggggacgggtaaccggaaccgtaacggtgaccgtaaccggtacgttacggtaaccggtacgaacccggtaccggaaccgttcccgtacccccccggtcccggg

SEQ ID NO: 150338 - DNA, 575 bp, Homo sapiens
  misc_feature: GYAE6OF01CW4VB.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcatttctctgcacaggctctgaggccctcctatgaactgacacagcccaccctcggtgtcagtcgtcccccaggacagacggccaggatcacgtgctctgcagagacgttgccaagtctaattttggtttttgatcagcaagaagtcaggccacggcccaagactgctcatgtatagagacagtgagaggtcctacgagggactcccgtaggacgacgtacttcgtcgtggtcctccaggtcctcggtgggaccgacactccacttctagtactatacgaggtagtaacggtccgggacaaggaagacggaggctagactaactattgtcgagtcgaggaacaacaatacgtcgacacgactaacgtacgtggttacggcgggaacggaccgaacggctacgacgtacgtaccgtaggtaccacgaccccgaaggcccgtcggtccccccg

SEQ ID NO: 150339 - DNA, 487 bp, Homo sapiens
  misc_feature: GYAE6OF01BX4L3.48.38.D05.1.454.CMB.1.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
  modified_base (462)..(462): a, c, t, g, unknown or other
  misc_feature (462)..(462): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaattttggtttttggatcagcagaagtcaggccaggcccaagactgctcatgtatagagacagtgagnggtcctcagggatccctgagcgattctctggctccagctcgtgggacacactcactctgactatcagtgaagtccgggnagagacgaggctagactactattgtcagtcagganacaatactcgcacgcaagtctggtcggnggacggacagctgacngtcagtcagcccaaggctcgccccg

SEQ ID NO: 150340 - DNA, 513 bp, Homo sapiens
  misc_feature: GYAE6OF01DUO0Y.48.38.D05.1.454.CMB.1.raw
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaattttggtttttggtatcagcagaagtcaggccaggcccaagactgctcatgtatagagacagtgagaggtcctcgagggatccctgagcgattctctggctcccagctcgtgggacgacactcactctagactancagtgagtccggnagaagacgagctgactatattgtcagtcaggaanaacaatactcgacacgacaagtctggttcggcggaagggacccagactagacacgtcctaggtccaacgcccgaaggcgtccgtacccccg

SEQ ID NO: 150341 - DNA, 374 bp, Homo sapiens
  misc_feature: GYAE6OF01CJRG2.48.38.D05.1.454.CMB.1.raw
  modified_base (364)..(374): a, c, t, g, unknown or other
  misc_feature (364)..(374): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaaggcccatcggtcttcccctggcaccctcctccaagagcacctctgggggcacagcggcctgggcctgcctggtcaaggacctacttcctctctcgactctgacgcgggctggcaaggcgcatagcnnnnnnnnnnn

SEQ ID NO: 150342 - DNA, 532 bp, Homo sapiens
  misc_feature: GYAE6OF01BHC47.48.38.D05.1.454.CMB.1.raw
  modified_base (394)..(394): a, c, t, g, unknown or other
  misc_feature (394)..(394): n is a, c, g, or t
  modified_base (437)..(437): a, c, t, g, unknown or other
  misc_feature (437)..(437): n is a, c, g, or t
  modified_base (470)..(470): a, c, t, g, unknown or other
  misc_feature (470)..(470): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctacttctccccctcctcattctctgcacaggctctgaggcctcctatgaactgacacagcccaccctcggtgtcagtcgtccccaggacagacggccaggatcacgtgctctgcagagacgttgaccaagtctaagttttggtttttggatcagcaagaagtcaggccacggccccaagctgctcatgtatagagacagtgagaggtcctacgagggactcccgngacgcgtacttctcgtggcctcgacgtctcgtacgggaccacncctcactctagactatcgagtcgaggtccgganagaacggacgaggtctacgacttacgtagttcgacagtacgaaggacactaaagtccgtacg

SEQ ID NO: 150343 - DNA, 505 bp, Homo sapiens
  misc_feature: GYAE6OF01AWMTI.48.38.D05.1.454.CMB.1.raw
  modified_base (424)..(424): a, c, t, g, unknown or other
  misc_feature (424)..(424): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttgatcagcagaagtcaggccaggcccaagactgctcatgtatagagacagtgagacggtcctgagggtactccctgagcgtattcgtcgtcggctccgagctcgtgggacacactcactctgactatcagtgacgtcggacagagacgagctgactactattgacgagtcgagganactaagtacgtacgcacgtacagtacgtgtcggacggaggaccagtcagcacgtcgagtcacgacccgagcctcgtccccg

SEQ ID NO: 150344 - DNA, 556 bp, Homo sapiens
  misc_feature: GYAE6OF01BQB7C.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaattttggtttttggatcagcagaagtcaggccaggcccaagactgctcatgtatagagacaggtgagaggtcctagagggatcccgtgagcgtattctctggctccagctcgtgggacgacactcactctgactatcagtgaacgtccgggacaaggaacgacggaggctacgacttacttagttcgtacacgtcgaaggacgaacgtaataccgtcgacaacggactaacgttcgtaggttccgggacgggacgggaccaaggctaggacgtagtccgtaaggtccgacgaccccgaaggtccgtccgtccccccg

SEQ ID NO: 150345 - DNA, 923 bp, Homo sapiens
  misc_feature: GYAE6OF01BRE5E.48.38.D05.1.454.CMB.1.raw
tcagagtatacatacacgaccggtgctcgatttagtatctgatagttggggtttggggtgggtccaggaggcagaactctgggtgtctcaccatggcctggatccctctaccttcctccccctcctcattctctgccacgaggctctgaggcctcctatgaactgacacagcccacccgtcggtcgtcgagtcgtccccgaggacaggaccggccgaggatcgacgtgctctgcagagacgttgccaagtctaagttttggttttgatcagcaagtaacgtcaggacctaggcccaagacctggctacgaattcgtaacgtaaggagacgtaggttggaaggtacggttccctaggaacgggtacttacccccggtaggaacggtccggtatttacccgtacgtacggccttaccgaagtccgttacggtacgggaaccgtactaccgttccaaccgttcgtacgtaaccgttagtaccgtaaggttacggtaaccggttacccggggaacgtaaacgggtaaaccggtacccgggtaacgggtaccgttaacgggtaaacccgtttaaccggtttaacggttttaccggtaccggttaaaccgggttaaccggaacggggttaaaccgtaaacccgttaaaacggtttaccccggtaaccgggtaacccgttaaaccgggttaacccgttaaaacgggtttacccgggttaaccgggggtttaacccgggggaaaccgggggtaaaaccgggggtaaaacccccggtaaaaggggtttacccccgggtaaacggggttaaaccccggttaaacccggggtttaccccgggtaaaccggggtttaacccggaaacccggggttaacccccgggtaaaaacgggggttcccccggttaacccccggggttaacccccccccggg

SEQ ID NO: 150346 - DNA, 391 bp, Homo sapiens
  misc_feature: GYAE6OF01CH6UI.48.38.D05.1.454.CMB.1.raw
  modified_base (378)..(391): a, c, t, g, unknown or other
  misc_feature (378)..(391): n is a, c, g, or t
tcagagtatacatacacgaccggtgctcgatttagtatctgatagttgggtttggggcagggaggggctaaggtgaggcaggtggcgccagccaggtgcacacccaatgcccatgagcccagacactggacgctgaacctcgcggacagttaagaacccagggcctctgcgccctgggcccagctctgtcccacaccgcggtcacatggcaccacctctcttgcagcctccaccaagggcccatccggtccttcccctggccaccctcctccaagacgcacctcgtgggggccacgacgccggcccgtgggcctcgccgtggtacaacggacctactttcctatgtatactctgacgcggtctggcaaggcgcatagnnnnnnnnnnnnnn

SEQ ID NO: 150347 - DNA, 673 bp, Homo sapiens
  misc_feature: GYAE6OF01CVI3G.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagcccacctcggtgtcagtcgtccccaggacagacggccaggatcgacgtgctctgcaggagtacgttgacctaagtctaattttggttttggatcagctagaagtcacggccacggacccaagactgctcaatgtaatacgagactaggtagaggtacgtccgtacgaagggtctccctaggaagcgtaatttcgtcgtcggacctcgacgtccgtacgtcggaactacgacctctacctcgtagaacctagtaccgtaaggtacgtaacggtccgggaacgtaaggaacggaacggaggtaccgtagttaacctacgttacgtttcggtactaaggttaccgaagtaacgaacgtaacgtacccgtacgaccgtaacggtaccaaaggtttaccgtacggttaccggggacgggaaacggaaccggtaaccgtagaccggtacgtaacggttcccggaaaggttaccccaccggtaacccgagggtcccgtccccggtaccccccgg

SEQ ID NO: 150348 - DNA, 569 bp, Homo sapiens
  misc_feature: GYAE6OF01A3LDC.48.38.D05.1.454.CMB.1.raw
  modified_base (484)..(484): a, c, t, g, unknown or other
  misc_feature (484)..(484): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaagttttggttttggtatcagcaagaagtcaggccacggccccaagctgctcatgtatagagacagtgagacggtcctcgagggtacctcccgtagacgtcgtagttcctcgtcggcctccacggccttcgtcgggaccacactccacttctacgtactactcaggttacgaacggtccggganaacggaagaccggacggcgtacgtaaccttaacgttagttcgttacctagtaccgaagggaacgacctaaagtcccgtaacccgg

SEQ ID NO: 150349 - DNA, 835 bp, Homo sapiens
  misc_feature: GYAE6OF01DRUJ6.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaattttggttttgatcagcagaagtcaggccacggacccaaagctgcctcatgtatagagacaggtgagacggtcctacgagggacttcccgtggacgtcgtactttccgtcgtcgggtccctccgaggtccgttacggttacggggaaccctaacctaccgttaccgaaccgtttccgttaggtaaaccttaacgttaccgtaaacgggttacgggtaaaccggggttccccggggaacggtaaacgggaaacgggaaccgggtaacgggtccgttaaacggttaacccgtttaaaccgtttaacgttttaccgggtaaccgtaacggttaaccgggtaacgggaaacgtaaaccctaaacgtttaacccgttacccgggaacctaaacgggtaacccgttaaacgggtttaaacccggttcggggtttaacccgggggaaaccggggtaaaccggggtaaaccccgtaacggggtaacgttaaccggaaacccggttaccgggtttaaccccggtaacggggttaaccccaaacccgggttacccccgggaaaaccggggttccccgttcccccgggttaaccccccccccggg

SEQ ID NO: 150350 - DNA, 402 bp, Homo sapiens
  misc_feature: GYAE6OF01DHRU8.48.38.D05.1.454.CMB.1.raw
  modified_base (393)..(402): a, c, t, g, unknown or other
  misc_feature (393)..(402): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgccgccctgggcccagctctgtcccacaccgcggtcacatggccaccacctctcttgcacgcctccaccaacgggcccatccggtccttcccctggccaccctcctaccaagacgccacctcgtcgggggcacgacgccggcccgtgggcctcgtccgtggtacaacggaccttacttcctatagtactactcgtgaggcggcgtcggacaacggcgcatagnnnnnnnnnn

SEQ ID NO: 150351 - DNA, 630 bp, Homo sapiens
  misc_feature: GYAE6OF01ELCW1.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaagttttggttttggatcagcagaagtcaggccaggcccaagactgctcatagtatagagacagtgagaggtcctcgaggtactcccgtgagcgtattctcgtggcctccgagtctcgtgggaccacgtactccgactcgtagactatacgtaggtacgaacggttccgggacaaggaacggacggtaacggacttaggaaccttacgttattggtacctaaggtaccgaagggtaacgaacgtaactaccgtaccgaccgtaccgacgtaacgtccgttagggttaccgggacgggtaacgggaacccgtaagccgttaacggaccgtaccggttacccgtaacggtaccgaaccggaccccgtaagggtcccgtcccggtacccccccgg

SEQ ID NO: 150352 - DNA, 620 bp, Homo sapiens
  misc_feature: GYAE6OF01C7PZ3.48.38.D05.1.454.CMB.1.raw
  modified_base (315)..(315): a, c, t, g, unknown or other
  misc_feature (315)..(315): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgagcctcctatgaactgacacagccaccctcggtgtcagtcgtccccaggacagacggccaggatcacgtgctctgcagagacgttgccaagtctaagttttggtttttggatcagcagagtcaggccaggcccaagactgctcatgtatagagacaggtgaggtacggtccngaggtactccgtagacgcgtattcctcgtcggcctccgagtcctcggtacgggacctactactcgactcgtagtactagtcgtagtacgtacggtcggactaaaggaacgacggtacgtagtacgtaaccttatagtacgatacgtacgaaggaacaactaaatccgtacgacacgtacgtaacgttacgtcggtaccgggacggtaaacgggacccgaaggtaccgtaggtaacccgtaacgggttacccgtaacggtacccgaaccggtaccccggtaaggtccccgtcccgtaccccccggg

SEQ ID NO: 150353 - DNA, 374 bp, Homo sapiens
  misc_feature: GYAE6OF01A6DV7.48.38.D05.1.454.CMB.1.raw
  modified_base (366)..(374): a, c, t, g, unknown or other
  misc_feature (366)..(374): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggccaccctcctccaagacgcacctctgggggccacagcggcccctgggcctgcctggtcaaggctacttcctctctcgactctgagcggctggcaaggcgcatagnnnnnnnnn

SEQ ID NO: 150354 - DNA, 463 bp, Homo sapiens
  misc_feature: GYAE6OF01E02BC.48.38.D05.1.454.CMB.1.raw
  modified_base (433)..(463): a, c, t, g, unknown or other
  misc_feature (433)..(463): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgcccgtgggcccagctctcgtcccacaccgcggtcacatggccaccacctctcttgcagccctccaccgaacgggcccatccggtccttcccccgtggcccaccctcctaccaacgacgcctacctcgtcgggggccacgacggccggccccgtgggcctcggtcccgtcgggtaccgaacggtaccttaccgttcctaagttcgtacttacgtcgttagggacggtccgggtcgtcggacgaagggccgtacagtaggcnnnnnnnnnnnnnnnnnnnnnnnnnnnnnnn

SEQ ID NO: 150355 - DNA, 642 bp, Homo sapiens
  misc_feature: GYAE6OF01CXM8O.48.38.D05.1.454.CMB.1.raw
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtcgtccccaggacagacggccaggatcacgtgctctgcagagacgttgccaagtctaatttggttttgatcagcagagtcaggccaggcccaagactgctcatgtataganacngtgagaggtcctgagggactccgtagacgcgtattcgtcgtggtccttaccgagtccgttacggtcgggaactaccacttcctactacgtacgaacttacgtacgagttacggaaacggtccgggaccaaagggaaacgaaccggaggtaccgtaggtaaccttaacttagtttagtacgaaggttacgaagggtaacgaaacgtaactttacccgaccgtacgaacgtaccgtaagttaccggtaggttaccgggaccgggaaacgggtacccgaaaggtccgtacgaacgtacgttacccgtaaggtaccacgacccggaaacggtccgtcccgtaccccccgg

SEQ ID NO: 150356 - DNA, 651 bp, Homo sapiens
  misc_feature: GYAE6OF01CRRKC.48.38.D05.1.454.CMB.1.raw
  modified_base (85)..(85): a, c, t, g, unknown or other
  misc_feature (85)..(85): n is a, c, g, or t
  modified_base (307)..(307): a, c, t, g, unknown or other
  misc_feature (307)..(307): n is a, c, g, or t
tcagagtatacatacacgaccggtgctcgatttagtatctgatagttgggtttgggggtgggtccaggaggcagaactctgggtntctcaccatggcctggatccctctacttcctcccctctcattctctgcacaggctctgacggcctctatgaactgacacacgccaccctggtgtcagtcgcccaggacaggacgcaggactcacgtgctcgtgcaaggtacgagttcgacctaagttctaagttttggttttgatcagcaagagtcgacggccaggacccaaagtactgccatatggtaaanagagacgagtaggagtacggtcaacggaggtacctccgaggacgtagtacttcgtcgtcgacctcgagtccgtaggacggacactactacactgtacgactagtacgaggtacgacggacggagaaggaacggacggagtctacgtaacttacgttagttcgtaacgaacggtacgaacggtaaactaaccgttaacgtaccggacgtaaccgaacgtaacgtaacgggttacggtacgggtaccggggaaccggtaacgggaaaccgtaacggtacgtaacggacgttaccggtacgtaacggacccgaaccgacccggtaacggcccgtaccccggtccccg

SEQ ID NO: 150357 - DNA, 902 bp, Homo sapiens
  misc_feature: GYAE6OF01DHRQ7.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcgggtgtcagtcgtccccagggacaggacggccaggatcacgtgctctgcagagacgttgccaagtctaattttggttttgatcagcaagagtcaggccacggacccaagacctgcctcatgtaatagagtaacagtagaggacggtcctagaacgggtactccccgtaggacggaccgtatttccgtacgttcgggtacccttcccgaacggtcccgtaccggttacgggggaaaccctaaccctaccgttacccgaactttaccgttacggtaaccttaacgttaccggtaagggttaaccggtaaaccggggttaccccggggggaacgtaaacggggaaaaccgggtaaacccgggtaaggggtaccccgtttaagggttaaaccctttaaacccggtttttaagtttaccgggtaacccttaacggggttaacccggaaagggggttaaaccctaaacgttaaaacccgtttaacccgggttacccggtaaaccccggtaaccggtaaacccggttaaagggtttaaacccggttttacgggggtttaaccccgggggaccggggggttaaaaccggggaaaccccgtaaaaagggtacccgttaaccgggtaaaaccccgtaacgggttttacccccggaaaacgggggttacccaaacccggggttaccccccggaaaacgggggttcccccgttaccccggggttaccccccccccggg

SEQ ID NO: 150358 - DNA, 528 bp, Homo sapiens
  misc_feature: GYAE6OF01DMTRO.48.38.D05.1.454.CMB.1.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (493)..(493): a, c, t, g, unknown or other
  misc_feature (493)..(493): n is a, c, g, or t
tcagagtatacatacacgaccggtgctcgatttagtatctgatagttgggtttgggggtgggtccaggaggcagaactctgggtgtctcaccatggcctggatccctctacttcctcccctcctcattctctgcacaggctctgaggcctcctatgaactgacacagccaccctcggtgtcagtcgtccccaggacagacggccaggatcacgtgctctgcagagtacgttgaccaagtctaagttttggtttttgatcagcagaagtcgaggccacggcccaagactgctcatgtataganacagtgagngtccngagggctccgngagcgtattcngtcggctccgagtctcgtaggacacnctcactngactanacagtgaacgtcggacaagaagcgtagctagactagttntcgtanagtacgaggagtaacaacgtactcgacaacggactaaggtcgtgtacggacggaacggaacagctagacgngtaccctaggccacgacccaggtccgcgtcccccg

SEQ ID NO: 150359 - DNA, 384 bp, Homo sapiens
  misc_feature: GYAE6OF01EWOOL.48.38.D05.1.454.CMB.1.raw
  modified_base (379)..(384): a, c, t, g, unknown or other
  misc_feature (379)..(384): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggccaccctcctccaagacgccacctcgtcgggggcacgacggtcggccccgtggggctcggccttggtcaaggacctacttcctatgtatactctgagcgggctggcaaggcgcatagnnnnnn

SEQ ID NO: 150360 - DNA, 629 bp, Homo sapiens
  misc_feature: GYAE6OF01AN14O.48.38.D05.1.454.CMB.1.raw
  modified_base (440)..(440): a, c, t, g, unknown or other
  misc_feature (440)..(440): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacacgcccaccctcggtgtcagtcgtccccaggacaggacggccaggatcgacgtgctctgcagagacgttgccaagtctaagttttggtttttggtatcgagcaagaacgtcgaggccacggacccaagctgctcatgtatagagacgaggtagacggacggttcctcggacgggtactccgtaggacgtcgtattcgtcgtcggctaccgagtccgtcggtagggaccactccgtcacttcgtagactagtacgaggtaggaacgggtccggganaaggaacgacggacggactacgtaactacgttacgttagtacagtacgaaggagtaacaactaccgcgacacgactagtaccgttgggtacggacgggtaacgggacccgaaggtccgtacggaaccgtacggttacccgttacggtaccgacggtaccccgaacggtcccgtcccgggtaccccccgg

SEQ ID NO: 150361 - DNA, 723 bp, Homo sapiens
  misc_feature: GYAE6OF01D5SPV.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctctcattctctgcacaggctctgaggcctcctatgaactgacacacgccacccgtggtgtcagtcgtccccgaggacaggacggccgaggatcgacgtgctcgtgcagacgtacgttcgacctaagtcttaagttttggttttagactcgagacgaaggaagtcgacggaccaacggacccaagtactcgactctaacgtagtaagtagaacggtactaggttagaacggtacggttcccgtacggaagggtacctcccgtaggaacgtcggttacttcgtcgtacgggtccctcgtaacggttcgtccgggttaaggacccgtaaacctaccgtcctacgttacgtacgtaacttaacgtccgaaaggtttacgaaccggggttaccggagaaacgggaacggacgtacggtcgtaacgttaacttacgtaacgtttacgcgtaagttacggaaaggtacctaaacgaccgtacgtaacccgacgttaacggacgttaacggttccggttacgggtaccggggacggtaacggaacctaacggtcgtacggtacgtacgtaccgttacgacgaaccgccgtaaggtccctcccggtaccccg

SEQ ID NO: 150362 - DNA, 632 bp, Homo sapiens
  misc_feature: GYAE6OF01DUJBP.48.38.D05.1.454.CMB.1.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (532)..(532): a, c, t, g, unknown or other
  misc_feature (532)..(532): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctacttctccccctctcattctctgcacaggctctgacggcctcctatcgaactgacacacgcccacccgtcggtgtcagtcgtccccaggacagaccggccaggactcgacgtgctntgacagngtacgttgaccaagttactaagtttttgggttttagactcgagacaagaacgtcgaacggccaacggaccccaagactgctnatgtaatagagacagtgagtacgtcncggaaggcttcccgtagacgcttacgttcgtacgtcggtccctaccgacgtccgtccggtacgggaacctacctacctcgtacttaccgtagtaaccttacgtccgtaggtacggaacgggtacccggganaaacgggtaacggacggtacggcccgttaaggtaacctttacgtacgtttcggtaaccgaacggtccgaaacggacgtaaacctaacgtccgtaacccgg

SEQ ID NO: 150363 - DNA, 590 bp, Homo sapiens
  misc_feature: GYAE6OF01BM6MX.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttgatcagcagaagtcaggccaggcccaagactgctcatgtatagagacagtgagaggtcctcgagggactccccgtggacgcgtattctcgtcggctaccagctcgtgggaccacactcactcgtagactatcaggtcgaacggtcccgggacaaggaacgacggagcgtacgaacttactagttcgtacgaggtacgaaggacgaaccaagtaccgtcgaccacgtacgtaacgtacgttcggttaccgggacgggtacgggaaccgtaaggcgtagaccgtacggttacccgtagggtacccacggtaccccgaacggtcccgttcccggtaccccccgg

SEQ ID NO: 150364 - DNA, 582 bp, Homo sapiens
  misc_feature: GYAE6OF01DB77C.48.38.D05.1.454.CMB.1.raw
  modified_base (222)..(222): a, c, t, g, unknown or other
  misc_feature (222)..(222): n is a, c, g, or t
  modified_base (431)..(431): a, c, t, g, unknown or other
  misc_feature (431)..(431): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccacccgtcggtgtcagtcgtccccaggacaggacggccaggatcacgtgctcngcagagacgttgccaagtctaagttttgggtttttgatcagcagagtcgaggccacggcccaagactgctcatgtatagagacagtagaggtacgtcctagagggacctcccgtaggacgcgtatttcgtcgtcgggcctccgagtccgtcggtagggaccactacctcactctgtactatcagttcgacggtcggagacgaagacggngactagactatattgcagtacgaggaataactagtacgtacgacacgtactacggttacgtacgggtaccgggacgggtaggaaccgtagtggttacgacgtaccggtactacggtccgaacgtcccgaacggtcccgtcccgtaccccgg

SEQ ID NO: 150365 - DNA, 774 bp, Homo sapiens
  misc_feature: GYAE6OF01EOR1X.48.38.D05.1.454.CMB.1.raw
  modified_base (180)..(180): a, c, t, g, unknown or other
  misc_feature (180)..(180): n is a, c, g, or t
  modified_base (235)..(235): a, c, t, g, unknown or other
  misc_feature (235)..(235): n is a, c, g, or t
  modified_base (501)..(501): a, c, t, g, unknown or other
  misc_feature (501)..(501): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctggaggcctcctatgaactgacacagcccacccttggtntcagtcgtccccaggacaggacggccaggatcacgtgctctgacagagtacgttnacctaaggtcttaagtttttgggtttttagattcgagcgaagtaagtcgacggcccgacggaccccaagtacgtgctcgagttggtaatacggagacgaggtaggacggtacggtccctagacgggtaccttcccgtaggacgtcgtatttccgtcgtcgggtaccctcgacgtccgttaccggtacgggaacctaaccgtacctttccgacgtttcgagttaccttagtccgtaacggtaacgggtaacgggttccccggggaanaaacgggaacgggaccggtaacggtccgttaacgtaaaccgttacttacggttcgtacgttaacgggtacgaaggtaacgtaacaacgttcctaccggacctaaccggtagtaaaccggtttcggtacggggttaccggggaaccgggaaacgggtaaccctaaggggtacccgttaacggtaaaccgttacccggggttacccgtaacgggtacccggtaaaccccggtacccgtaaccgggttcccgttaaccccccggttaccccccggg

SEQ ID NO: 150366 - DNA, 690 bp, Homo sapiens
  misc_feature: GYAE6OF01DWSJ8.48.38.D05.1.454.CMB.1.raw
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggactccctctacttcctccccctcctcattctctgcacaggctctgacggcctcctatgaactgaccacacgcccacccgtcggtgtcagtcgtccccaggacaggacggccaggatcacgtnctcngcaggacgacgttcgacctaagttacttaagtttttgggttttggatcgagcaagaagtcgacggaccacggaccccaagtctgctactagtagtaagagaacgacgtaggtaggaacggtacggtaccctagggaacgggtaccttcccggtaggacgttaccgttactttccgtcggtcggtcccctaccggtaacgtcccgttacgggtaccgggtaaccctaaccctacgttacctaaccgttccgttaacgtaacctttacgtaccgtaagggttaccggaaaccgggtcccgggaagtaaacgggaaacggaccggtaaggtccgttaacgtaacttacgttagttaccggacgaaaggttccggaaagggaactaaccgtaacgtccgtaaccgg

SEQ ID NO: 150367 - DNA, 659 bp, Homo sapiens
  misc_feature: GYAE6OF01DZTTT.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacagccaccctcggtgtcagtcgtccccaggacaggacggccaggatcacgtgctctgcaggagacgttgccaagtctaagttttggtttttaggtatcagcaagaacgtcaggccaggacccaagtacctggcctcattagtataggagacgagtggagacggtcctgacgggtactcccgtgacgcgtacttcgtcgtggtcctccgaggtcctcggtagggaaccacgacctacgaccttcgtagtactatacgaggtacggaacggttccgggacgtaaaggaacggacggaacgggtcgtaacgtaaccgttaacttagtttacggtacgtagttaccggaagggaactaaacgtaactaccgtacggaccgaacgtaaccgtaaggttaccgttgggtaccgggacgggtaaccggaacgaacggtcgacgtaacggacggttacgaacgggtccgaacgacccgtacgggtcccgtcccggtcccccg

SEQ ID NO: 150368 - DNA, 634 bp, Homo sapiens
  misc_feature: GYAE6OF01EA2QM.48.38.D05.1.454.CMB.1.raw
  modified_base (286)..(286): a, c, t, g, unknown or other
  misc_feature (286)..(286): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggactccctctacttcctccccctctcattctctgcacaggctcgtgacggcctcctatgaactgacacacgcccacccgtcggtgtcagtcgtccccgaggacacgaccggccaggatcgacgtnctctgcagagacgttgaccgtaagtacttaagttttggttttagtaatcgagacaaggtaacgtcgaacggccaaccggaccccaaaggacctgactacatacgtaatagacgacgaggttacgacggtacggtccctacggagggtacctcccggtagcgtacgtacttcgtcgtcggccctcgtacgtccgtcggacggacctacgaccgtcacgttctacgttaactacgtacgacggttaacgaccgggtaccggaacgtaaggaaccggacggtacgtacgtacgtaacttagttacgttacgtacgtaaggtccggaaaggtaccaacgtaagtcccgaacg

SEQ ID NO: 150369 - DNA, 569 bp, Homo sapiens
  misc_feature: GYAE6OF01BWNYJ.48.38.D05.1.454.CMB.1.raw
  modified_base (449)..(449): a, c, t, g, unknown or other
  misc_feature (449)..(449): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttggatcagcagaagtcaggccaggcccaagactgctcatgtatagagacagtgagaggtcctagagggatccccgtgacgcgtattccgtctggcctccagcctcgtcgggacctacacgtcaacgtctagactatcagtcgaacggtccgggacaagaacggacgaggctaggaccttactattcgtcaggtcgaagganaactaatacctcgactaacgtcaacgttacgtggttaccggacggaacgggaaccgaggtacttcggaactcggttaccgtagggtccacggacccgaacggccgtcccggtaccccccg

SEQ ID NO: 150370 - DNA, 618 bp, Homo sapiens
  misc_feature: GYAE6OF01EK64V.48.38.D05.1.454.CMB.1.raw
  modified_base (180)..(180): a, c, t, g, unknown or other
  misc_feature (180)..(180): n is a, c, g, or t
  modified_base (421)..(421): a, c, t, g, unknown or other
  misc_feature (421)..(421): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacagcccaccctggtntcagtcgtccccaggacagacggccaggatcacgtgctctgcagagacgttgaccaagtctaagttttggttttgatcagcaagaagtcaggccacgacccaagactgctacatagtatagagacagtgagacggtcctagagggtactcccgtaggacgtcgtacttctcgtggcctcgagtctcggtacgggaccacactacacttcgacgtaactatcgaggtacgaacggtccgganaacggaacgacgaggtctagtactacgtcgttgtacgagtacgaacgggaacaactaactaccgtaccgaccgaacgtacgaaacgttccgttgggtaccgggacgggaacgggtaaccgaacggtctaacggaacgtaccggttaacccgacggttaccgaccggacccgaacggtcccgtcccggtaccccccgg

SEQ ID NO: 150371 - DNA, 747 bp, Homo sapiens
  misc_feature: GYAE6OF01ETJU6.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctggtgtcagtcgtccccaggacagacggccaggatcacgtgctctgcagagtacgttgaccaagtctaagttttggtttttggatcagcagaagtcaggccaggcccaagactgctcatgtatagagacagtgagtacggtcctgagggactcccgtagacgtcgtatttctcgtggccttaccgagtcttacggtaggggacctaaccgaccttaccgaccgttcgtacggtaaccttacgtacgtaaggttacggtaaccgggttcccggggaacaaacgggaaacggaccgggtaacgggtccttaacggtaacctttaacgtttagtttcggtactaacggttacgaagggtaacgaaccgtaaacgttaccgtaccggacctaaccggtacttaaacggttaccgttacgggtttacccggggaccggggtaaaccggggtaacccgtaaacgggtcccgttaacgggaacccgttaaaccgggtttaccccggtaaaccgggttacccgtaaacccggaacccccggtaaacgggtccccgttacccccgggttacccccccccggg

SEQ ID NO: 150372 - DNA, 695 bp, Homo sapiens
  misc_feature: GYAE6OF01BAOZB.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagacgacgttgccaagtctaagttttgggttttgatcagcaagaagtcaggccacggcccaagactgctcagtgtatagagacaggtgagtacggtcctacgagggtacttcccgtaggacgtccgtatttcgtcgtcggtcctcccgaggtcttcggtaggggaaccactaccgtcaacgttcgtacgtaccttatacgtaggtagaacgggttcccgggacgtaaggaacggacggacggtacgtacgtaacttacttagttcgtacgtagtacgaagggtacgaactaacgttaacccgtaccgaccgtaacggtaacgaacggttaccggttggggttaacccggggacggggtaacgggaacccgtaacggtaccggtaacggtaaaccggtaccgttacccggttaaccgggttacccgaaccggtaaccccgggtaaaccgggtccccgtcccgggtaccccccccgg

SEQ ID NO: 150373 - DNA, 640 bp, Homo sapiens
  misc_feature: GYAE6OF01BE4BK.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctggtgtcagtcgtccccaggacagacggccaggatcgacgtgctctgcagagacgttgacctaagttctaagttttggttttgatcgagcagaagtcaggccacggcccaagctgctacatgtaatagagacagtgagacggtcctgaggtactcccgtagacgcgtattccgtcgtacggcctacgacgtccgttcggtacgggaacctaccaccttaccacttcgtagtaaccttacgtcgaggttacggtaacgggtacccgggacaaagggaacggtacggacggtacgtagtaaaccttagttacgtttagtaccgtaggtaccgaacggtaacgtaactaacgttaccgacgacctaacgtaccgtaagttccgtgggttaccggcgggtaacggaccgtagtacgtaggaccacgttacgtaacggtccgacggacccgtaacgccgtcccgtccccgg

SEQ ID NO: 150374 - DNA, 709 bp, Homo sapiens
  misc_feature: GYAE6OF01BYE36.48.38.D05.1.454.CMB.1.raw
  modified_base (300)..(300): a, c, t, g, unknown or other
  misc_feature (300)..(300): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaagttttggttttgatcagcagaagtcaggccacggcccaagactgctcatgtatagaganaggtgacggtggtcctacgacgggtactccccgtaggacgcgtacttccgtcgtcggacctcccgagtccgttcggtacggggaccgtaaccacccttcgacccttcgtacgtaaccttaacgtccgtaaggttacggaaaccgggttcccggggaaccgaaagggtaacgaacggacggtacctacggaaccttaacgtttaagttcggtaacgacggttacgaacgggaactaacgtaaacttacccgtacggaacccgaaccgaacgtaacggttaccggtacgggttaccggggaccggggaacggggtaacccgaaggtccgtaaccggtaacgtacccgggttaaccgttacgggtaaccgtacccggaccccgtaacgggtcccgtccccgggtaccccccg

SEQ ID NO: 150375 - DNA, 607 bp, Homo sapiens
  misc_feature: GYAE6OF01B658S.48.38.D05.1.454.CMB.1.raw
  modified_base (332)..(332): a, c, t, g, unknown or other
  misc_feature (332)..(332): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctggtgtcagtcgtccccaggacagacggccaggatcacgtgctctgcagagacgttgacctaagtctaagttttggttttggtatcagtcaagaagtcaggccacggcccaagactgctcatgtatagagacaggtgagacggtcctgagggactccgngacgcgtattcgtcgtcggcctccgagtccgttacggtacggggaacctactacgttccaccgttcgtacgtaacttactacgtaaggttacggaacggtccgggacgaaagggaacgacggacggactagtacttacgttagttagtacgtagtacgaaggaacaactaactacgtcgacacgactaacggtacgtcgggtacggacgggaacgacgacggtcacggacgtcgtaccgtagtacgacgacccgacggtcccgtccgtaccccgg

SEQ ID NO: 150376 - DNA, 697 bp, Homo sapiens
  misc_feature: GYAE6OF01BKH5Q.48.38.D05.1.454.CMB.1.raw
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacacgcccaccctcggtgtcagtcgtccccaggacagaccggcctaggatcacgtnctcgtgcagagacgttgacctaagtcaagtttttggttttcgatcagacgaagagtcagccacggacccaagactgctacatgtatagagacaggtgagtcgtccngagggtactcccgtagagtacacgtttctcgtggaccnccgtaagcttacggtcgggacctaacaccgtactaccgttcgtacgtacgtacgtacgtacgtaggaacgtcgggactaaaggaacgaacggacggctacggtaacttaactagtttacgtacgtaagtcgaacggtacgaaaccttaacgtaccgtaaccgtacgaaccggtaccgtaaacgttacggtacgggttacccggggaacggttaaccgggggaaaccaacgggtttaccgaacgggtaacccggaaccggtttacccgggaacggtacccttaaacccgggcccccggtaaacgggtcccgttccccccgggttaaccccccccgg

SEQ ID NO: 150377 - DNA, 593 bp, Homo sapiens
  misc_feature: GYAE6OF01EGWD8.48.38.D05.1.454.CMB.1.raw
  modified_base (303)..(303): a, c, t, g, unknown or other
  misc_feature (303)..(303): n is a, c, g, or t
  modified_base (464)..(465): a, c, t, g, unknown or other
  misc_feature (464)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (479)..(480): a, c, t, g, unknown or other
  misc_feature (479)..(480): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
  modified_base (540)..(540): a, c, t, g, unknown or other
  misc_feature (540)..(540): n is a, c, g, or t
  modified_base (574)..(574): a, c, t, g, unknown or other
  misc_feature (574)..(574): n is a, c, g, or t
tcagagtatacatacacgaccggtgctcgatttagtatctgatagttgggtttggggcagggagggggctaagggttgaggtcaggttggtacgccgagccaggtgcacgaccaatgcccatgagcccaggacactggacgctgaaccgtcgcggacagttaacgaacccaggggcctcgtgccgtcccgtggggcccagtctactacgtcccacgaccgcggtcacagtcggccaccgacctctcgttcgacgacgccgtaccgaccggaacgggcccaagttaccggttcccttcccccgnggcctaccctccgtaccgaacgacgacctaacctcgtacggggaccacgacgtccggacccgtgggtcctcgccgttcggtaccgaagggtacctaacttaccgtaagttacgtactacttcgtgtaacgcggacgtggacgaacggcgacgagtaacggnngncgntagngtatnngngagagntangnantgtgtgtgngatagcagacgngacgacgtcgcgacgtctcgtacncgcgacacgacgacgacgcgtcgtcgtccgcgcncgtcacgagacgcgcgacg

SEQ ID NO: 150378 - DNA, 765 bp, Homo sapiens
  misc_feature: GYAE6OF01DX7AN.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacacgcccaccctcggtgtcagtcgtccccaggacaggacggccaggatcacgtgctctgcagagacgttgaccaagtctaagttttgggttttgtatcagcaagtaacgtcgacggccacggacccaagactgctcatgtatagagacaggtgacgtacggtcctacgagggtactcccgaggacgtcgtacttcgtcgtcggtcctaccgacgtccgttcggtacggggaaccctacctaccgttcctacttccgttacgtacctttaacgttaccgtaagggttacggaaccgggttacccgggtaacgaaacgggtaaaacggacgggtaacggtcgttaacgtaaccgtttaacgtttagtttaccggtacgtaacggttacggaacggaacgtaaccgtaaacgttacccgtaccggtaaccgtaaccgtaaccgttaacggttacccggttacggggttacccggggaacggggtaaacccgggaacccgtaaacgggtaccgttaacggaaccggttaaccggttacccggtaacggtacccgtaaaccggtaccccggtaacgggtccccgtacccccgggttaccccccgg

SEQ ID NO: 150379 - DNA, 744 bp, Homo sapiens
  misc_feature: GYAE6OF01EIM1O.48.38.D05.1.454.CMB.1.raw
  modified_base (537)..(537): a, c, t, g, unknown or other
  misc_feature (537)..(537): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctggtgtcagtcgtccccaggacagacggccaggatcacgtgctctgcagagtacgttgacctaagtcttaagttttgggtttttaggattcgagacaaggtaacgtcgacggcccgaacgggaccccaaggtacctcgaccttacgtagttacggtaaagtaggaaggtaaccgaagggttaggaacgggtaccgggtaccttacggaacggggtaccttccccggtaggtacggtaccgtaacgtttccgtcggtcggacccttaccgaggtcccgttcgggtacggggaacctaccgtacttaccgtaaccttcgtacgtaacttacgtaccggtaaggtacgggtaaccggtaccggggaanaacgggaacggaccggtaggtaccgttacggtaactttacgtacgttcgtacgtaacgtaggaaggtaacgaactaaacgtcgtaccggactaaccgagtaacgtacgtgggtaccggacgggtaaccggacgtaaggtctaacggtaccgacgttacccggtaggtacccgtacggaccccgtaaggtccccgtccggtacccccg

SEQ ID NO: 150380 - DNA, 817 bp, Homo sapiens
  misc_feature: GYAE6OF01CZYT4.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggccctcctatgaactgacacacgcccaccctcggtgtcagttcgtcccccaggacaggacggccaggatcacgtgctctgcagagacgttcgaccaagttctaagttttgggtttttggtatcgacgtcaagaacgtcgacggtcccgaacggaccccaaagtacctgccttctaagttacggtaataaggacgtaacgaggtaggacggtacggtcccgtacgaacggggtactccccgtaggacgtcgtactttcctcggttcggcctcccgtacggtccgttcggtacggggacccaacctaccgtacctaacttcgtacgtacgttaacgtacgtacggttaacggtaacggttcccggggaacgtaaacggaaacggtaacggacggtacctacggtaaccttaacgttacgtttacggtacgtaacggttaaccgaacgggtaacgaaaccgttaacgttacccgttaccgaaccgtaacccggtaacccgttaacgggttaacccgtttacggggttaccgggaaccggggtaacccgggtaaaccggtaaacggtaccggttaacggaaacccgttaacccgggttaacccggtttaacgggtacccgtaaaccccgggtacccggaaacccgggttcccggttcccccggtaaccccccggg

SEQ ID NO: 150381 - DNA, 662 bp, Homo sapiens
  misc_feature: GYAE6OF01DOZVT.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacaggaccggccaggatcacgtgctctgcagagacgttgaccaagtctaagttttggtttttggtatcagcaagaagtcaggccagaccccaagactgctcatacgtaatagagacgaggtagacggtacggtcctacggagggtactccccgtagacgtcgtaactttcgtcgtcggtccctaccgacgtcgtcggtacgggtaacccgactacctcgtaacttctagaccttagtaccgtagtaacggtaacggtacccgggacgaacggaaacggaaccggtacgggaccgtaggtaaacccttacgttaacgttcgtacgacggttacgaagggaacgtaacgtaacgttaccgtcgaccacggtaacgtacgttacgtcgggttacggacgggtaacggacgaacgcgtagaaccgtacgtaccgtagtccgaacgtacccgaacggtccgtcccgtacccccg

SEQ ID NO: 150382 - DNA, 739 bp, Homo sapiens
  misc_feature: GYAE6OF01DXIKK.48.38.D05.1.454.CMB.1.raw
  modified_base (231)..(231): a, c, t, g, unknown or other
  misc_feature (231)..(231): n is a, c, g, or t
  modified_base (688)..(688): a, c, t, g, unknown or other
  misc_feature (688)..(688): n is a, c, g, or t
tcagagtatacatacacgaccggtgctcgatttagtatctgatagttgggtttgggggtgggtccaggaggcagaactcgtgggtgtctcaccatggcctggactccctctacttcctccccctcctctattctctgcacaggctctggagcctctatgaactgacacacgcccacccgtggtgtacagtccgtcccgaaggacaggaccggcgaaggactcacgtgctcngcagagtacgttcgacctaagttcttaagtttttgggttttagatacgagcgaaggtaacgtccgacggacccaaccgggacccaaagtcctcggtccttacgtaagttacggtaaagtacggaacgaacgtaggtaggacggttaccggtccctaacgggaagggtaccctcccgtaagggacgtacgttactttccgtcgttcggtccctaccgtacgtcgttaccggacggggaacccactaccgtaccgtacttacgtaacggttaactaacgtacggtacgggtaacgggtaccgggtaccgggtaacgaaacgggaacggtaacggtacggtacgttaacggtaactttaacgttacgtttacgtaacgtacggtaacggtagggaactaactaacgtccgtacgacgaacgtacgtagttacggtcggaccgggacggacggacgtacgngtacgacgtacgtacggacgtacgaaccggacgaacggccgtcccgtcccg

SEQ ID NO: 150383 - DNA, 602 bp, Homo sapiens
  misc_feature: GYAE6OF01EZNXU.48.38.D05.1.454.CMB.1.raw
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtcgtccccaggacagacggccaggatcgacgtgctctgcagagacgttgaccaagtctaagtttttggttttagatcagcgagaagtcaggcccaggacccaagactgctacgatgtagagacgtacngtaggagtacggtcctagagggtactcccgtagagtcgtatttccncgtggcctccaggtctccgtagggactaccactcacttcncgtaactactcgagtagacggtccgggacaaggaacgacggacggtacgtagaacttacgttagttgacgtagtaccgaggacgaacagtaccgtgacctacgactaagtaccgttgggtcggacgggaacgaccgaagtacgtagaccgtacgtaccgtaaggtacccgacggaaccccgacggtccgtcccgtaccccccgg

SEQ ID NO: 150384 - DNA, 705 bp, Homo sapiens
  misc_feature: GYAE6OF01CRIUV.48.38.D05.1.454.CMB.1.raw
  modified_base (346)..(346): a, c, t, g, unknown or other
  misc_feature (346)..(346): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgactgacacacgcccacctcggtgtcagtcgtccccaggacaggacggccaggactcgacgtgctcgtcgcaaggagtacgttacgacctaagttacgttaagtttttgggtttttaggtactacgaaggtcgaaaggtaacgtcgacgggacccaacggacccaagtactcgctactatgtaagtaganacgtgtaggaggtcggtcctaggaacgggtacctcccgtaggacgtacgtacgtttccgtcgtcgtcccgtaccgagtccgttacggacgggaaccacctctactacgttcgtaacgtactacggtacgtaaggtacggaacggtaccgggaacgtaagggaacggacggtacgtcgtaacgtaaccttagttacgtttcggacgtacgaacggacgtaacaacgttacaccgtacgtacgacgtaacgtacgttccggtaagggccggaaacggaccggtaacgcgtccggttacggaccgttaccggacggtaccgaccggtaaccgacggtacccgtcccgtcccccggttacccg

SEQ ID NO: 150385 - DNA, 826 bp, Homo sapiens
  misc_feature: GYAE6OF01BSS07.48.38.D05.1.454.CMB.1.raw
  modified_base (148)..(148): a, c, t, g, unknown or other
  misc_feature (148)..(148): n is a, c, g, or t
  modified_base (327)..(327): a, c, t, g, unknown or other
  misc_feature (327)..(327): n is a, c, g, or t
  modified_base (697)..(697): a, c, t, g, unknown or other
  misc_feature (697)..(697): n is a, c, g, or t
tcagagtatacatacacgaccggtgctcgatttagtatctgatagttgggtttgggcacgaccggtgctcgatttagtatctgataggttgggtttggggtggggagcctagctgtgctgtgggtccaggaggcagaactcgtgggtntctacaccatcggcctggactccctctaccttccctccccctctcacttctctgcacgaggtcctcgtggacgtcctacctagtacgaactgacaccgacgccctacccgttcggtcgtcctaacgtccgaccccgaaggaaccgacggtaccggacgacgggtactccgtacggttcnccgttacgacggaccgtaaggtaacggttaccggtttaccgaaccgttaaacggtttaccgttttaaagggtttttttggttttacggtaactccggtaacggtaccgtaaaggtaacgttaccggaaccgggtaccccgtaacgggacccccgtaaaaggtcccttaggtacccttacgttaaggttacgtaaacggtaacggaacgggtaaacgtacgggttaggaaccgggttaacccggttccgtaaccggggtacgggtaaccccttccgggtagtaaccggttcgtttacgttccgtaccggtaccgtaccgtacgtcggtaccgttaccgggaacgacctaacgttacctacctaaccggttntaacggtactaccgtaggtaaccggtacgggaaacccggtccggaaagaacgggaatacgggtactacgtaaccgtattacgtcgttcggaacgtaacgaccgtaagaaccaacttaacggtccgaaac

SEQ ID NO: 150386 - DNA, 704 bp, Homo sapiens
  misc_feature: GYAE6OF01EZVDN.48.38.D05.1.454.CMB.1.raw
  modified_base (216)..(216): a, c, t, g, unknown or other
  misc_feature (216)..(216): n is a, c, g, or t
tcagagtatacatacacgaccggtgctcgatttagtatctgatagttgggtttgggggtgggtccaggaggcagaactctgggtgtctcaccatggcctggatccctctacttcctcccctcctcattctctgcacaggctctgaggcctcctatgaactgacacagcccaccctggtgtcagtcgtccccaggacaggacggccaggatcacgtnctctgcagacgtacgttcgacctaagttcttaagtttttggtttttgtactcagcgagaagtcgacggccgaacggcccaaagtacgtcgactactagtgtaagtaagagacgagtaggtacggtacggtcctacggagggtactcccgtagacgtcgtacttccgtcgttcggacctccgacgtccgtcggtacggaaccgacctacgtacctacgttcgtacgtaaccttaacgtccgtaaggtacgggtaacgggtcccgggacgaaaggaacggaacggtacgtcgtacgtaaccttacgttagttcgtactacggtacgaagggaacgtaacctaagtacccgtaccggacctacgtaacgtaacggttaccggttcgggtacccgggaaacgggaccgggaaccgtcggtaggtacggaccgtaacggttccgtacggtacgacccggacccgtacgggtccccgtccccggttacccccgg

SEQ ID NO: 150387 - DNA, 468 bp, Homo sapiens
  misc_feature: GYAE6OF01DH0EK.48.38.D05.1.454.CMB.1.raw
  modified_base (190)..(190): a, c, t, g, unknown or other
  misc_feature (190)..(190): n is a, c, g, or t
  modified_base (439)..(468): a, c, t, g, unknown or other
  misc_feature (439)..(468): n is a, c, g, or t
tcagagtatacatacacgaccggtgctcgatttagtatctgatagttgggtttgggggcaggggagggggctaaggtgaggcaggtggcgccagccaggtgcacacccaatgcccatgagcccagacactggacgctgaacctcgcggacagttaacgaacccgaggggcctctgccgccctgggcccanctctcgcccacaccgcggtcacatggccaccacctctcttgacacgcctaccaaccgacgggcccagtccggtaccttccccgtggcctaccctccgtaccacgacgccgaaccgtccggtcgggggaccacgacggcccggccgtcgggcgtccgccggtttaggaccgtaacggtaccttacttacctagttcgtaacttcgtctagggacggccgggttcgacggaccgaaaggcgaactacgagnnnnnnnnnnnnnnnnnnnnnnnnnnnnnn

SEQ ID NO: 150388 - DNA, 840 bp, Homo sapiens
  misc_feature: GYAE6OF01BM0V5.48.38.D05.1.454.CMB.1.raw
  modified_base (90)..(90): a, c, t, g, unknown or other
  misc_feature (90)..(90): n is a, c, g, or t
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (567)..(567): a, c, t, g, unknown or other
  misc_feature (567)..(567): n is a, c, g, or t
tcagagtatacatacacgaccggtgctcgatttagtatctgataggttgggggtttgggggtgggtccaggaggcagaactcgtggggtntctcaccatcggcctggactccctcttacttcctccccctctctattctcgtgcacgaggctctggacgtccttctagtacgaactgaccacgacgccctacccgttcggttntaccgaggttccgtaccccgaagggaacacggaccggacctaaggtactccgtacgttntccgttacgcgaaccgtaggacgtaccggttaccaaccgtttaaggttacgttttaaggttttttgggttttacgaatacgtacggaacgtaaaggtaaccgccgaacggacccgaacggaacccgtaaagtcctagtcctaagtacgtacgtaaaggaggaacgtacgtaggtacggtacggttccggttaaccgcgtaacgggtaccgttaccgtaaggtacgtactttccggtttcgtcggtttacccggccttaaccggtaggttccgtaaccggggtaacggaaacccctacgtttaccnccgtttacgtacgttactacgttacgtacgtacggtacggtacggacggaagaacggaacgaggtacgtacgtacgtacgttaattcgtagtacgtaacgtacggtaacgaacgtaacgtaacgtaccgtacgaccgtaacgtaaccggtacgttaccgggttaacggacggggtacgggaaaccggtacggtaacgtcggttaacgccggtaaacgtacggtaccggtaaccggaccgtaccgggttcccgtcccggtaccgggttaccccg

SEQ ID NO: 150389 - DNA, 871 bp, Homo sapiens
  misc_feature: GYAE6OF01BEL0Y.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctccccctctcattctctgcacaggctctgagcctctatgaactgaccacacgcccacccgttggtatcgtagtccgtaccccgaggaccaggccggaccaggactcgacgtgcctcgtgacgagtacgtacgttcgaaccgtaacgttagttaagttttttgggttttagactacgtaagacgtaaggtaacgtccgaacgggaccccgtaacggaaccccgaaggtacctcggcttaaccgtagttacgtaagaaggacggtaactagggtagtacggtacggttttccgacggaaacgggttccttaccgtaggtaacggtacgttacctttccgtcggttaccggcccttaaaccgtcgggttacccgttaacccgggtaacgggtaacccaaccgttcctttacgtaaaccgttccgttacgtaaaaccgttacgttaaccggtaacgggtttaccggaaccgggtttaccgggaacgaacgggtaaacggtacggaacgtttaccgtacgtttaaacccgtagtttaccgtcgtaagttacggaacgaacgtaacgaaccttaacgtcccggtaagaccctaaacggttaccgtaaacggttccgggttaacgggtaccggggtaaaccgggtaaccggtaaacggtccggtaaccggtttaacggaaacccgttaccgggtaaccggtacccgttaaacgggaccccgttaaccgggtaacccggttccccgacccccggttaccccggg

SEQ ID NO: 150390 - DNA, 459 bp, Homo sapiens
  misc_feature: GYAE6OF01DV99O.48.38.D05.1.454.CMB.1.raw
  modified_base (436)..(459): a, c, t, g, unknown or other
  misc_feature (436)..(459): n is a, c, g, or t
tcagagtatacatacacgaccggtgctcgatttagtatctgatagttgggtttggggcagggaggggctaaggtgaggcaggtggcgccagccaggtgcacaccaatgcccatgacgcccagacacgtggacgctgaacctcgcgacagttaacgaacccgaggggcctcgtgccgtcccgtcgggcccagcctctcgtacccacgtaccggcgtcacagtcggccacctactctcttgccacgccctaccaccgaacgggccctagtccggtaccttcccccgtggcctacccctcctaccaacgtacgcctaccgttcggcgggacacgaggcccggcccgtagggcctcggtccgtacggtacgaaacgtcttaccttactagtcgttacacgtgtacgggcgtccggtagtcggaccgagcgtacaagtgcnnnnnnnnnnnnnnnnnnnnnnnn

SEQ ID NO: 150391 - DNA, 882 bp, Homo sapiens
  misc_feature: GYAE6OF01EOR9M.48.38.D05.1.454.CMB.1.raw
  modified_base (299)..(299): a, c, t, g, unknown or other
  misc_feature (299)..(299): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggagcagactctgggtgtctcacatgcctggactcctctacttcctcccctctcattctctgcacgagtctctggacgtcctcctagtacgaactgaaccacaccgccctacccggtcggtcgtacacggttccgtaccccgaggaccacggaccggcaggtactcgacgtnctcgtgactacggaacgtaccggttacggtacctaacgtttacttttaaaggtttttgggttttacgactcgagtacgtaacgtacggtaccgaaccgggccgtaacccggacccgtaaagacgttacgacttacgaagtttacggtaacgtaacggtaacggtaaccggtaggttaaacgggacgggtaccggtttacccgtacggggtaaccgggtttacccgttaccggttaacggggtacgttaaccgggttttacgtttaccccgttacgggtcccggttaacccccgttaaccggtaacggtttcccggggttttaaacccgggaacgggtacccctaaccgtaacccctttccgggaacctttaccgggttaaccgtaacttacgggttacccgtaaacggggttaccggtaaccggggttccccgtaaaaggggaacccgtaaaggggtacccggggtaaaccgtcgtttaaaccgggttaaaccccgttaggttttaccccgggtttacggaacggttaaacccgggaacggtaaacgtaaacccggttaacgtaacccgttaaaccccgggcg

SEQ ID NO: 150392 - DNA, 660 bp, Homo sapiens
  misc_feature: GYAE6OF01E0NNT.48.38.D05.1.454.CMB.1.raw
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggccctctatgaactgacacagcccaccctcggtgtcagtcgtcccccaggacaggaccggcctagggatccgacgtcgctcctgccaaggagtacggttcgaccctaagtcttaagtttttgggttttttaggaacttcgaagccaagtaaagtcaggccctaacggaccccaagactgcctactattgtaataacgagactaggtgaggtaccggtcctagacgggtatccccgtaggagcggtactttcacggtcggccttaacgngttcctcgggacgggacctacncttacgacttcgtanaacttgtaccgtagtaggaacgtcccggganaaggtaacgacggttgacgttagaacttagttattcgtaacgtacgtacgaaggacctaacgtaagtccgtcgaaccacgacgtaaacgtttcgacgggttaccgggacggtacggaaccgtagctacggactacgttaccgagtaccacgtacccgaggtcccctccggtcccccg

SEQ ID NO: 150393 - DNA, 688 bp, Homo sapiens
  misc_feature: GYAE6OF01DZROH.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagtactttgccaagtctaagttttggtttttgtatcagcagagtcagccacggcccaagctgctcatgtatagagacagtgagacgtcctagaggactccgagacgtgtattcctcgtcgcctccgagtccgtcgtacgggacaccgtacctacgacttctacggtaacttactacgtaacggttacggaacggtacccggggtaactaaaggaaacgggacgggtacggtcctaaggttaccttaactttagtttcggttacgtaggtaccggaaggtaacgaaacctaattaacccggccgtaacaccggttaactaacgggttccttacggggtaccggtaaccggggaaccgggtaaacccaaggtacccgtacgtaacccggtaacggttacccgttaaaccgggtaccctaacccgggaccccggtaaagggttcccccgtccccgggtacccccccgg

SEQ ID NO: 150394 - DNA, 715 bp, Homo sapiens
  misc_feature: GYAE6OF01C6CXW.48.38.D05.1.454.CMB.1.raw
  modified_base (146)..(146): a, c, t, g, unknown or other
  misc_feature (146)..(146): n is a, c, g, or t
  modified_base (332)..(332): a, c, t, g, unknown or other
  misc_feature (332)..(332): n is a, c, g, or t
  modified_base (487)..(487): a, c, t, g, unknown or other
  misc_feature (487)..(487): n is a, c, g, or t
tcagagtatacatacacgaccggtgctcgatttagtatctgatagttgggtttgggcacgaccggtgctcgatttagtatctgataggttgggtttggggtgggagcctagctgtgctgtcggtccaggaggcagactcgtgggtntctcacatggcctgactcctctacctttcctccccctctctactttctctcgcacgacggccttacgtaggacgtcccttaccgtatacggaacctgaaccacgtaccgaccccgtaccgtcggttcgtacgacgttaccggaccccgaggaccgaacggccgtaccgaggtactacgacgttacnctacgacgacgagtacgtacgttacggaaccttaaagttcgttttaaggttttggtttaacgtactacgtaacgtaacgtaagaaacgtccggaacggaccccgtaacgaccgtaacggtactcgacgtactaagtaagtataaggactagtagnggaaacgtcgtcggtagaacggtcctacgtaggtacgtcgtactttcgtacgtacgttccgacgtaacgttccggtaaccgacggaaccgtttcaaccgttacgtcttaacgtagtaccttagtaccgtagacggtacgaccgtaagacggaacgtagacgtctaaacggtacttaacgtggtaactacggaacgtaccggtaaagattaaacgtacgtgaaacccgg

SEQ ID NO: 150395 - DNA, 723 bp, Homo sapiens
  misc_feature: GYAE6OF01C9WB5.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctccccctcctcattctctgcacagctctgacgcctcctatgaactgacacgacgcccacccgtcggtcgtcgagtccgtacccccgaggaccacggaccggaccaggactccgacgtgcctcgcgacaggacgtacgttacgaccttaagttacttaaggtttttggtttttagactacgaacgtacgaaaggtaacggtaccgaaccggtacccgaaccgggaaccctaaggtactacgcctactacgttagtaagtaggacgtaacgtaggtacggtacggtacggttctacggacggtcctccgagacgtaccgttcttcgtcgtcgacctaccgtagtcgtaccggtacggaaccacttactccgtactgtaacgtacacgtacgaggtaccgaggtacccggaagtaacggaacgacggacgtctaacgtacgttacttacgtcgtacgacgtacgaagactaactacgtacgcgtaaccgacgtaacgtagttacgggtcgggtaaccggcggtaacggaaacgcgtagtaacggtacgtaccgggttaccaacgggtaacccgacggcccggtaacctcccgggttccccgtacccccggg

SEQ ID NO: 150396 - DNA, 535 bp, Homo sapiens
  misc_feature: GYAE6OF01CT0RX.48.38.D05.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (305)..(305): a, c, t, g, unknown or other
  misc_feature (305)..(305): n is a, c, g, or t
  modified_base (385)..(385): a, c, t, g, unknown or other
  misc_feature (385)..(385): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (471)..(472): a, c, t, g, unknown or other
  misc_feature (471)..(472): n is a, c, g, or t
  modified_base (481)..(482): a, c, t, g, unknown or other
  misc_feature (481)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (491)..(492): a, c, t, g, unknown or other
  misc_feature (491)..(492): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (507)..(513): a, c, t, g, unknown or other
  misc_feature (507)..(513): n is a, c, g, or t
  modified_base (515)..(517): a, c, t, g, unknown or other
  misc_feature (515)..(517): n is a, c, g, or t
  modified_base (522)..(527): a, c, t, g, unknown or other
  misc_feature (522)..(527): n is a, c, g, or t
  modified_base (529)..(532): a, c, t, g, unknown or other
  misc_feature (529)..(532): n is a, c, g, or t
  modified_base (534)..(535): a, c, t, g, unknown or other
  misc_feature (534)..(535): n is a, c, g, or t
tcagagtatacatacacgaccggtgctcgatttagtatctgatagttgggtttggggcaggggagggggctaaggtgaggcaggtggcgccagccaggtgcacacccaatgcccatgacgcccagacacgtggacgctgaacctcgcggacagttaaacgaacccgaggggcctcgtgccgcccgtcggcccagctctcgtcccacgccgcgtcanacgtcggcaccncctctcttcgcncgcctccaaccgacggcctagttccggttcccttccccgtacggcctacccctcccacaacggcncccgtaccgtcggtcggggcacgaccggtccggcccgtaggccgtcgccgtggtaaccgacggtaccttacgtttacctntagttacctacgttccggaggaccgggtcggtacgtccggacggtaacgccgacgtactaggnagngactgagcnggtcagncgtnngactctagnntncntcganngcancngnacgnngnnnnnnncnnncgcannnnnngnnnngnn

SEQ ID NO: 150397 - DNA, 732 bp, Homo sapiens
  misc_feature: GYAE6OF01BXKE1.48.38.D05.1.454.CMB.1.raw
  modified_base (89)..(89): a, c, t, g, unknown or other
  misc_feature (89)..(89): n is a, c, g, or t
  modified_base (148)..(148): a, c, t, g, unknown or other
  misc_feature (148)..(148): n is a, c, g, or t
  modified_base (269)..(269): a, c, t, g, unknown or other
  misc_feature (269)..(269): n is a, c, g, or t
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (670)..(670): a, c, t, g, unknown or other
  misc_feature (670)..(670): n is a, c, g, or t
tcagagtatacatacacgaccggtgctcgatttagtatctgataggttggggtttgggggtgggtccaggaggcagaactcgtggggtntcctcaccagtggcctggactccctcttaccttccctccccctctctattctctgcacnggtctcgtggacgtccctactagtacgactcgaccaccgaccgccccgtaccggtcgggttcgtaccgacggttcccgaccccggagggacacggaccggtaccaggctacgcgtgctcgngacgagtcgttaccggtcacgttacgtttattttaaggtttttggtttacggtacnccgaagacgaaggtacgacgccgggacccgtaaccgacctaagtctagtcctagtattaggagaaggtaacacgtggtacggaagtaccggctaacggngtaccgtcggagttacgactttccgtagttcgccgtaccacggtntccgggtaaccggngtaacccgtccaaacgttcttactacgggttacattacgtagtacggtaacggtaccggaacggacgaacggaacggtacggtaacgtacgtacgtaccgtttaacgttagcgtacggaagtacgaagtctacgacgtcgacacgtacacggtacgtcggtaccggaggaccggagaccgtacggtnacggtacccggtacgtccggtaacggcccgtaaccggtacgtacccggccgtccccggtacg

SEQ ID NO: 150398 - DNA, 746 bp, Homo sapiens
  misc_feature: GYAE6OF01CAMQI.48.38.D05.1.454.CMB.1.raw
  modified_base (182)..(182): a, c, t, g, unknown or other
  misc_feature (182)..(182): n is a, c, g, or t
  modified_base (451)..(451): a, c, t, g, unknown or other
  misc_feature (451)..(451): n is a, c, g, or t
tcagagtatacatacacgaccggtgctcgatttagtatctgatagttgggtttgggggtgggtccaggaggcagaactctgggtgtctcaccatggcctggatccctctacttcctcccctctcattctctgacacgaggctctgacggtcctcctatgaactgacacagccaccctcggtntcagtcgtccccaaggacaggaccggcaggatcgaacggttcgctacgtgcgaaggtagacgttgaccgtaaagttcgttaaagtttttgggtttttaggacctagacgacaaggtaaacgtcgaacggaccgaacggacccaaagacgttcgaccgtactaagtagttaagaggtaaacgcaaggtgaacggacggttaccaggaacgggtcctaccgtggacgacttattccgtgacggtcaccgtagtccgtagtcggaacttacncgtttacacgtagtagtactactacgaagttccggaacggtccggaacgaacgtaacggacggtacgacgttagaaaccttagtacgttagagtacgaacgtacggaagtaacctagtaacctacgaccgtaacgtaacctaaggtttaaccgtggggttaaccgggacgggtaaaaccgggtaccctaaacgggtaccggttacggaaaccgttaaaccggtcccggtaacgggttaacccgaaacccggttaacccggtaaccccggtccggttaccccgttaaccccccggg

SEQ ID NO: 150399 - DNA, 367 bp, Homo sapiens
  misc_feature: GYAE6OF02ILXTJ.48.38.D05.1.454.CMB.1.raw
  modified_base (363)..(367): a, c, t, g, unknown or other
  misc_feature (363)..(367): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctgggctgcctggtcaaggactacttcctatgtatactctgagcgggctggcaaggcgcatagnnnnn

SEQ ID NO: 150400 - DNA, 515 bp, Homo sapiens
  misc_feature: GYAE6OF02IXPBR.48.38.D05.1.454.CMB.1.raw
  modified_base (399)..(399): a, c, t, g, unknown or other
  misc_feature (399)..(399): n is a, c, g, or t
tcagagtatacatacacgaccggtgctcgatttagtatctgatagttgggtttgggggtgggtccaggaggcagaactctgggtgtctcaccatggcctggatccctctacttctccccctcctcatttcgtctgcacaggctcctgaggcctcctatgaactgacacagcccaccctcggtgtcagtgtccccaggacagacggccaggatcacgtgctctgcagagacgttgccaagtcaatttggttttgatcagcagaagtcaggccaggccccaagactgctcatgtatagagacagtgagaggtcctcgaggggatcccgtgagcgattctctggctcagctcgtgggacatactcactctgactatcagtgaacggtcgggcaggaagacgnggctgactatattgtactagtacgaggagactaatactcgcacgctaagtactgttacggcggaggaaccgagctgacgacgtacgtaggccacgcccgaaggcctaccgtccccg

SEQ ID NO: 150401 - DNA, 367 bp, Homo sapiens; identical to SEQ ID NO: 150399
  misc_feature: GYAE6OF02GF9C9.48.38.D05.1.454.CMB.1.raw
  modified_base (363)..(367): a, c, t, g, unknown or other
  misc_feature (363)..(367): n is a, c, g, or t

SEQ ID NO: 150402 - DNA, 568 bp, Homo sapiens
  misc_feature: GYAE6OF02FW5AK.48.38.D05.1.454.CMB.1.raw
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagagtatacatacacgaccggtgctcgatttagtatctgatagttgggtttgggggtgggtccaggaggcagaactctgggtgtctcaccatggcctggatccctctacttctcccctcctcatctctgcacagcgtctgaggccgtccctactgactagacacagccaccctccggtggtcacgtgtccccacggacgagacggccgaggagtcacgtgctcctgcagagacgttgccaagtacaatttaggtttttggttatctagcacgaagtacaggccgaggacccccgaacgaatcggctcatggtatagagacaagtgagaggtccgtcaggggatcctcgaggcgattctctggctccagctctgggacgacactcnctctgactatcngtaggaagtccgggcgagaaaggacgaggctgtaactacttattgtcgtcaggagnaactanccganaccganaacgtagttcggttcggacgggagggaccaacgcgtacgtacgaacgttccgtaagggttcacggaccccgaagggcttccggcccccttcccggg

SEQ ID NO: 150403 - DNA, 499 bp, Homo sapiens
  misc_feature: GYAE6OF02ILGNH.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctagactactattgtcagtcagagacaatactcgcacgcaagtactgttcggcggagggaccaagctagacagtcctaggtcagcccgaaggcctcgtcccccg

SEQ ID NO: 150404 - DNA, 369 bp, Homo sapiens
  misc_feature: GYAE6OF02G8KFV.48.38.D05.1.454.CMB.1.raw
  modified_base (362)..(369): a, c, t, g, unknown or other
  misc_feature (362)..(369): n is a, c, g, or t
tcagagtatacatacacgaccggtgctcgatttagtatctgatagttgggtttggggcagggaggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnnnn

SEQ ID NO: 150405 - DNA, 496 bp, Homo sapiens
  misc_feature: GYAE6OF02HWX7P.48.38.D05.1.454.CMB.1.raw
  modified_base (384)..(384): a, c, t, g, unknown or other
  misc_feature (384)..(384): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggnagaagacgaggctgactactattgtcagtcaggagacaatactcgcacgcaagtacgtgttcggcggaggaccaagctgacagtcctaggtcagcccgaaggcctgcccccg

SEQ ID NO: 150406 - DNA, 372 bp, Homo sapiens
  misc_feature: GYAE6OF02HW9VM.48.38.D05.1.454.CMB.1.raw
  modified_base (362)..(372): a, c, t, g, unknown or other
  misc_feature (362)..(372): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctgggctgcctggtcaaggctacttcctatgtatactctgagcgggctggcaaggcgcatagnnnnnnnnnnn

SEQ ID NO: 150407 - DNA, 371 bp, Homo sapiens
  misc_feature: GYAE6OF02IBWER.48.38.D05.1.454.CMB.1.raw
  modified_base (362)..(371): a, c, t, g, unknown or other
  misc_feature (362)..(371): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctggctgcctggtcaaggactacttcctctctcgactctgagcgggctggcaaggcgcatagnnnnnnnnnn

SEQ ID NO: 150408 - DNA, 368 bp, Homo sapiens
  misc_feature: GYAE6OF02H5GR5.48.38.D05.1.454.CMB.1.raw
  modified_base (362)..(368): a, c, t, g, unknown or other
  misc_feature (362)..(368): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctggctgcctggtcaaggactacttcctatgtatactctgagcgggctggcaaggcgcatagnnnnnnn

SEQ ID NO: 150409 - DNA, 572 bp, Homo sapiens
  misc_feature: GYAE6OF02G3VGE.48.38.D05.1.454.CMB.1.raw
  modified_base (328)..(328): a, c, t, g, unknown or other
  misc_feature (328)..(328): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtgtccccaggacagacggccaggatcacgtgctctgcagagacgttgaccaagttcaagttttggttttgatcagcaagaagtcaggccaggccccaagactgctcatgtatagagacagtgagacggtcctcgagggctccgngacgcgatttcgtcgtggcctccgagtctcgtgggacactactcactctagactancagtgaacgtcgganagaagcgagctagtactatattgacgagtcgaggacaactaatacgtcgacacgacgtaaagttacgttggttacgggacggaacggtaaccaaggttccttaacggaccgttacgttacccgttaacggtccgaaccggacccgtaacgggtccctacccggtaccccccgg

SEQ ID NO: 150410 - DNA, 500 bp, Homo sapiens
  misc_feature: GYAE6OF02GZO5R.48.38.D05.1.454.CMB.1.raw
  modified_base (419)..(419): a, c, t, g, unknown or other
  misc_feature (419)..(419): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggatcagcagagtcaggccaggccccaagactgctcatgtatagagacagtgagaggtcctcgagggatcccgtgagcgattctctggctccagctcgtgggacgacactcactctgactatcagtgaagtccgggcagaagacgagcgtgactactattgcagtcagganacaatactcgcacgacaagtactgttcggcggaggaccgaagctagacacgtcgtaggtcagcccaaggcctcgtcccccg

SEQ ID NO: 150411 - DNA, 376 bp, Homo sapiens
  misc_feature: GYAE6OF02H7Y82.48.38.D05.1.454.CMB.1.raw
  modified_base (359)..(359): a, c, t, g, unknown or other
  misc_feature (359)..(359): n is a, c, g, or t
  modified_base (365)..(376): a, c, t, g, unknown or other
  misc_feature (365)..(376): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccagggcctctgcgccctgggcccagctctgtcccacaccgcggtcacatggcaccacctctcttgcagcctccaccaagggcccatccggtcttccccctggccaccctcctccaagacgcacctctcgggggcacagcggccctgggcctgcctggtcaaggactacttcctatgtatactctgagcggctggcaggcncatagnnnnnnnnnnnn

SEQ ID NO: 150412 - DNA, 516 bp, Homo sapiens
  misc_feature: GYAE6OF02HBBIR.48.38.D05.1.454.CMB.1.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (441)..(441): a, c, t, g, unknown or other
  misc_feature (441)..(441): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtgtccccaggacagacggccaggatcacgtgctctgcagagacgttgccaagtcaattttggttttggtatcagcagaagtcaggccaggccccaagactgctcatgtatagagacagtgagaggtcctgagggactcccgtgacgcgtattctctggctccagctcgngggacacnctcactctgactatcgagtgaaggtccggganaaggaagacgaggctagactactattgcagtcgaaggagaacaatacncgacacgacaagtacgtgtcgacggaggacaagctagacgagtccgtaggtcacggacccaggtcctcgtccccg

SEQ ID NO: 150413 - DNA, 501 bp, Homo sapiens
  misc_feature: GYAE6OF02FS5GN.48.38.D05.1.454.CMB.1.raw
  modified_base (387)..(387): a, c, t, g, unknown or other
  misc_feature (387)..(387): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctgagggactcccgtgagcgattctcgtggctccagctcgtgggacacactcactctgactatcagtgaacgtccggnagaagacgaggctgactactattgtcagtcaggagacaatactcgcacgcaagtactgtcggcggaggaccaaggcagacagtccgtaggtcacgcccaaggcctcgtcccccg

SEQ ID NO: 150414 - DNA, 492 bp, Homo sapiens
  misc_feature: GYAE6OF02GSKPP.48.38.D05.1.454.CMB.1.raw
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggatcagcagaagtcaggccaggccccaagactgctcatgtatagagacagtgagaggtcctcgagggactcccgtgagcgtattctctggctcagctctgggacacactcactctnactatcagtgaagtccggnagacgacgnggctgacttactattgtcagtcgagganacaatactcg

SEQ ID NO: 150415 - DNA, 494 bp, Homo sapiens
  misc_feature: GYAE6OF02IBCRW.48.38.D05.1.454.CMB.1.raw
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggatcagcagaagtcaggccaggccccaagactgctcatgtatagagacagtgagaggtcctnagggatccctgagcgattcnctggctccagctctgggacacactcactctgactatcagtgaagtccgganagaagacgagctgactactatgcagtcagganacaatactgcacgcaagtactgtcggacggacggaccaagctgacagtccgtaggtcagacccgaaggtcctcgtccccg

SEQ ID NO: 150416 - DNA, 511 bp, Homo sapiens
  misc_feature: GYAE6OF02GZTLD.48.38.D05.1.454.CMB.1.raw
  modified_base (392)..(392): a, c, t, g, unknown or other
  misc_feature (392)..(392): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttggtatcagcagaagtcaggccaggccccaagactgctcatgtatagagacagtgagaggtcctgagggactcccgtgagcgtattctcgtggctccgagctcgtgggacacactcactctgactatcagtgaacgtccggganagaagacgaggctgactactattgtcagtcgaggagacaatactcgacacgacaagtacgtgtcggcggacggaccagctagacacgtcgtacggtcacgccgaaggtcctcgtccccg

SEQ ID NO: 150417 - DNA, 509 bp, Homo sapiens
  misc_feature: GYAE6OF02HDY2F.48.38.D05.1.454.CMB.1.raw
  modified_base (387)..(387): a, c, t, g, unknown or other
  misc_feature (387)..(387): n is a, c, g, or t
  modified_base (430)..(430): a, c, t, g, unknown or other
  misc_feature (430)..(430): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtcccccaggacagacggccaggatcacgtgctctgcagagacgttgccaagtcaattttggtttttggtatcagcagaagtcaggccaggcccccaagactgctcatgtatagagacagtgagaggtcctcagggatccctgagcgattctctggctccagctctgggacacactcactctgactatcagtgaagtccgggnagaagacgaggctagactactattgcagtcaggagacaatacncgcacgcaaagtactgttcggcggagggaaccaaggctaggaactagtcctagggtcacgcccgaaggcctcgcccccg

SEQ ID NO: 150418 - DNA, 662 bp, Homo sapiens
  misc_feature: GYAE6OF02JGQUL.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtcgtccccaggacagacggccaggatcacgtgctctgcagagacgtgccaagtcaatttggttttgtatcagcagtaagtcaggccaggccccaagactgctcatgtatagagacagtgagaggtcctagaggactcccgtgacgcgtatcgtcgtggtcctcgacgcttcgagggaccgactactacacttcgtagtacttacgtacgtagtacgaaacggtcccggggacaaagggaaacgaccgggaacgggaccttacggaaacctttaacgttactttacggttccgaacggtttaccggaaggtaaacgtaacctaaagttaccgttaccggacctaaccggtaacctaaacggttaaccgtacgggtttacgggaccgggtaacggggaacctaaggaccgtacggtaactaacggttcccgtaacgggtaccaccggtaaccccggaacggtccctacccggtaccccccgg

SEQ ID NO: 150419 - DNA, 504 bp, Homo sapiens
  misc_feature: GYAE6OF02JEE8D.48.38.D05.1.454.CMB.1.raw
  modified_base (433)..(433): a, c, t, g, unknown or other
  misc_feature (433)..(433): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttgatcagcagagtcaggccaggccccaagactgctcatgtatagagacaggtgagaggtcctcgagggatcccgtgagcgattctctggctccgagtcctcgtgggacgacactcactctgactatcagtgaacgtccggacagaagacgaggctagactactattgctagtcaggagacaatacncgacacgcaagtctgtcggcggaggaccaggctagactagtccgtaggtcacgcccaaggcctcgcccccg

SEQ ID NO: 150420 - DNA, 591 bp, Homo sapiens
  misc_feature: GYAE6OF02IDQ6D.48.38.D05.1.454.CMB.1.raw
  modified_base (239)..(239): a, c, t, g, unknown or other
  misc_feature (239)..(239): n is a, c, g, or t
  modified_base (480)..(480): a, c, t, g, unknown or other
  misc_feature (480)..(480): n is a, c, g, or t
tcagagtatacatacacgaccggtgctcgatttagtatctgatagttgggtttgggcacgaccggtgctcgatttagtatctgatagttgggtttgggtggggagcctagctgtgctgtgggtccaggaggcagaactctgggtgtctcaccatggcctggatccctctacttcctccccctcctcattctctgcacaggctctgagcctcctatgaactgacacagcccacctcggtntcagtcgtccccaggacagacggccaggatcacgtgctctgcgagagacgttgaccaagtctaattttggttttaggtattcagtcaagtaagtccaggccacgggaccccaaagtccgtagactcaagttgtaagaagagaactagtgaagtacggtcctacgagggtactcccgtgacgcgtattcgcgtggccttccagtccttagcggggaacaccacgtcctactcctagacttanaccgtagtacggaacggttcccggaagaacgaagaccggacggtaccgtacggtaaccttaccgttagttccgagacggttaccaaggtaacgaactaacgtactacccgg

SEQ ID NO: 150421 - DNA, 653 bp, Homo sapiens
  misc_feature: GYAE6OF02G8WVF.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttgatcagcagaagtcaggccgacgacccaagactgctacatagtagtagacgacgtaggtgaggtacgtccaggacggtacctccgtaggacgtagtactttcgtcgtcggtcctaccgagtcctcggtacgggaacctacctaccgtacctaccttcgtacgtaactacgtacgtaaggttacgggtaaccgggtcccgggacgaaagggtaaacgaccgggtacggtccgtaagtaacccgtttaattacgttcgtacgtacggtacggaagggaacaaaccgtaactcccgtacgactaaccgacgtaaacgttacgttcggtaccgggacgggtacggaacgaacgcgtacgacgtcgttaccggtacgtcgaccgtaccggacggtcctccccgtccccg

SEQ ID NO: 150422 - DNA, 540 bp, Homo sapiens
  misc_feature: GYAE6OF02GTHOV.48.38.D05.1.454.CMB.1.raw
  modified_base (404)..(404): a, c, t, g, unknown or other
  misc_feature (404)..(404): n is a, c, g, or t
  modified_base (452)..(452): a, c, t, g, unknown or other
  misc_feature (452)..(452): n is a, c, g, or t
  modified_base (493)..(493): a, c, t, g, unknown or other
  misc_feature (493)..(493): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaatttggttttgtatcagcagaagtcaggccaggccccaagactgctcatgtatagagacagtgagacggtcctcgagggactccgtgacgcgtactttcgtacgtcggctccgagtcctcgtggggaaccacactacactctgactatcagtgaacgtccggganaggaagacgaggctgactacttattgcagtcgaagacaactaataccncgacacgactaagtactcgtcggacggtacggaccgaagcnggaactacgtacgtacggtcacggaccgaacggtccgaccgtccccg

SEQ ID NO: 150423 - DNA, 638 bp, Homo sapiens
  misc_feature: GYAE6OF02IKRT3.48.38.D05.1.454.CMB.1.raw
  modified_base (337)..(337): a, c, t, g, unknown or other
  misc_feature (337)..(337): n is a, c, g, or t
  modified_base (551)..(551): a, c, t, g, unknown or other
  misc_feature (551)..(551): n is a, c, g, or t
tcagagtatacatacacgaccggtgctcgatttagtatctgatagttgggtttggggcgacgaccggtgctcgactttagtatctgatagttgggtttggggtggggagcctagcgtgtgctgtgggtccaggaggcagaactctggggtgtctcaccagtggtcctggactccctctacttcctcccctcctcattctctgcacaggctctcgaggcctccgtatgaactgacacgagcccaccccgtggtcgtcaggtcgtcccagacagacggccaggatcgacgtgctctgcagagacgtgccagtctaagtttgtttcgatcagctagagtnacggccacggcccaagactcgactcagtcgtagtagacacgtagttgacggtacggtccgtaggacggggtacctcccgaggaaccgtcgtacttcgtacccgtcggtacccgtccgtaaggtcccgttaccggtaccgggaaccgtaacctacccgtcgtaaccgtccttaccgtaactaccgtaccgtacggttacgaccgggttacccggngtaacggaacggtcggcgtaccgtacgtaaccttaccgtagttacggtaacacggtaccggaggtaccgaacgtacgtccgtaccgg

SEQ ID NO: 150424 - DNA, 581 bp, Homo sapiens
  misc_feature: GYAE6OF02I3SJN.48.38.D05.1.454.CMB.1.raw
  modified_base (388)..(388): a, c, t, g, unknown or other
  misc_feature (388)..(388): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttggtatcagcagaagtcaggccaggcccccaagactgctcatgtatagagacagtgagaggtcctcgagggatcccgtgagcgattctctggctccagctcgtgggacgacactcactctgactatcagtgaagtcgganagaagacgagctagactactattgtcgagtcgaggagaacaagtactcgactacgacgtaaacgtacgttacggttcgggacgggtacggggaaccaaaggtccgtaacggtaaccgtaaccggttacccggtaacggggttcccgaaccgggaccccgtaacgggtacccgttacccgggtaccccccccgg

SEQ ID NO: 150425 - DNA, 669 bp, Homo sapiens
  misc_feature: GYAE6OF02GQMEL.48.38.D05.1.454.CMB.1.raw
  modified_base (448)..(448): a, c, t, g, unknown or other
  misc_feature (448)..(448): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaagttttggtttttggattcagcaagaagtcaggccacggaccccaagactgctcatgtatagagacaggtgagtacggtctcgaagggtactcccgaggacgcgtatttccgtacgtcgggtaccttccgaagtccgttacgtacgggggaacccaacctactccgtaccttcgtacgtacctatcgaggtaggaacggtcccggganaaggaacggacgacggtactacggaacttacgttagttgtaacgacggtacgaaggaacgtaaacctaagttacccgtacgtaaccgaacggtaaccgtaacggtttaccgttcgggttaccggggacggggtaacgggaccaaaggtccgtaacggaacccgtacggttccgtaacggtccgacccggtacccggaaggtcccctaccggtaccccccgg

SEQ ID NO: 150426 - DNA, 609 bp, Homo sapiens
  misc_feature: GYAE6OF02GLSW7.48.38.D05.1.454.CMB.1.raw
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgtgccaagtctaattttggttttgatcagcagaagtcaggaccacggacccaagactgctcatgtatagagacagtgagtacggtcctgacggactcccgtgacgcgtattctcgtcggcctaccgagttcccgtgtcggggaaccaccgtacctccgtaacttccgtagtaacctagttaccaacggttacggaaccgggttcccgggacgaacggtaaacggtacggacgggtaccgtaacggtaaccgtttaacgtttagtttacggtaccgtacgggttaacgaacgggaacgaaacctaacgttaccgtaacccgg

SEQ ID NO: 150427 - DNA, 785 bp, Homo sapiens
  misc_feature: GYAE6OF02H0E34.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtcgtccccaggacagaccggccaggatcgacgtgctctgcagagtacgttgaccaagttctaagttttgggtttttggtatcgagacagtaagtcgacggaccacggacccccaaaggacctggacctacgtagtacggttaataaggaaggtaaccgaaggtggaacggacggttacccgtaggacggggaccttcccgtaggacgacgtactttccgtacgttcggaccttccgagtccgtcggtacggggaccaacctaaccgtctaaccgttcgtagaaccttagtacgtaacggtaacggtaaccggtacccgggaacggaaacggtaaacgggaaccggaacgggtaccggttaacgtaaccgtttaacgttaacgttacggttaccgtaacggtaccgtaaagggtaaccgtaacgtaaaccgtaccgttaccggacccgtaacgtaccgtaaacggtaacggttacgggttaccgggaccgggtaaccgggtaaccggtaacggttccgtaacgggtaaccgtaccggttacccggtaacgggtacccgtacccggaaccccgtaacgggtcccgtacccggttaccccccgg

SEQ ID NO: 150428 - DNA, 647 bp, Homo sapiens
  misc_feature: GYAE6OF02IYJVQ.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtcgtccccaggacagacggccaggatcacgtgctctgcagagacgttgccaagtcaagttttggttttagatcagcagagtcgaggccaggccccaagactgctcatgtatagagacaggtgaggtcggtcctagagggtactcccgtggacgcgtattctcgtacggtcctccagtctcggtacgggacctaccgacttccgaaccttcgtagtacctataccgtaaggtcgaacgggttccgggacaaagggaacggacggaggacctagtaaccttacgttaagttcgaccgtacggtaccgaagggaacaaaccgtaacgttaccgaccggaccgacgtaacctaacggttaccgttgggttaccgggcgggaacggaccgaacggtcttacggaaccgtacggttccggtaacggttacccacggtacccggaacggtcccgtacccggtacccccgg

SEQ ID NO: 150429 - DNA, 585 bp, Homo sapiens
  misc_feature: GYAE6OF02F7NX0.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaacttgacacagccaccctggtgtcagtgtccccaggacagacggccaggatcacgtgctctgcagagacgttgccaagtcaatttggttttgatcagcagagtcaggccacggccccaagactgctcatgtatagagacagtgagaggtcctacgagggtactcccgtggacgtcgtagtttcgtttggccttccgagtccttcgtacgggaccgtacacctcctactcgtacgactatcgagtaggaacgtcggacgaagaacgacgacgctagacttactagttacgctagtacagggacaacgaataccgtcgacacgacaacgtacgtcgttaccgggaggacggtaccaacggtcgtacgaacgtacggttaccgtaggtacctacggacccgtaacggtccctccgtacccccggttaccgg

SEQ ID NO: 150430 - DNA, 693 bp, Homo sapiens
  misc_feature: GYAE6OF02GO07H.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtcaattttggttttggatcagcagaagtcaggccaggccccaagctgctcatgtaatagagacagtgagtaggtcctcgagggactcccgtagacgcgtactttcgtcgtcgggcctaccgagtccttcggtacggggaacctacctaccgtctaaccgttctacggtaaccttagtaccgtaggttacggaaccggtcccggggaactaacggaaacggacggtacgggtaccttacgggtaaaccttaccgttaagttcggtaaccgtacggttaccgaacgggtaacgaaaccttaacgttaccgttaccggacgtaaccggtacctaaacggttaaccgttacgggttaccggggaccgggtaacggggtaaccaacgggtactacggaaccgtacggttaccgtacgggtccgaaccgtaccccggtaacgggtcccgtcccgtacccccgg

SEQ ID NO: 150431 - DNA, 664 bp, Homo sapiens
  misc_feature: GYAE6OF02JNLKC.48.38.D05.1.454.CMB.1.raw
  modified_base (463)..(463): a, c, t, g, unknown or other
  misc_feature (463)..(463): n is a, c, g, or t
  modified_base (484)..(484): a, c, t, g, unknown or other
  misc_feature (484)..(484): n is a, c, g, or t
tcagagtatacatacacgaccggtgctcgatttagtatctgatagttgggtttgggggttgggtccgaggaggcgagaactctgggtgtctcaccatggcctggatccctctacttcctcccctcctcacttctctgcacaggctctgaggcctcctatgaactgacacagcccaccctcggtcgtcacggtcgtacccccaggaccgacgaccggaccgaacggatccacggttcgccttccgtgccaggaagtacgtttacgcctaaagtcttaaagtttttgggtttttacggattcaggtcgtaagtaacggtcaacggggccaccgggaccccaagacgttggcctacgagtgtaactaggaagactaggtagaggacggtctacggaggggtactcccgtgaggcctacgttacgtcgtacgggtctccacgggtccttacggcgggaacgtaaccnccgttacactctaagccttanctaggtacgtaacgtccgggaacgtagaaacggacggcgtacgagtactaacgttagttgtacgagtacgagagtaacgaacgtcgcgtaccacgtacaagttaccgagttccggaggacggacgaacgtcgaggacctagtaccggtacgtacgacgacccgaggtccctaccggcccg

SEQ ID NO: 150432 - DNA, 758 bp, Homo sapiens
  misc_feature: GYAE6OF02IQMTR.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgacggcctcctatgaactgacacacgcccaccctcggtgtcagtcgtccccaggacagaccggccaggatcacgtgcctctgacagagtacgttcgaccaagttctaagtttttgggttttaggtatcgagcaaggtaagtcgacggacccgacggacccccaagactgcctacgtatgtaataacggagacgtaggtagaggtacggtcccgtagacggggacttcccgtgacgtcgtacttccgtcgtcggtcctaccgtacgtctcggtacgggaacctaccgtacctcctaaccgttccgtacgtaaccttatacggtaacggtacggtaaaccgggtcccgggaacgtaaacgggaacggtaacggacggtaccgtagggtaaacctttaacgtttacggtttcggtaactacggtaccggtaaagggtaacgtaaccgtaacgtaccgtacccgacgtaaacccggtaacgtaaacggtttaaccggtagggttacccggggaccgggtaacggggaacccgtaacggtaccggtaacggtaaccgtaccggtaccggttacggaccgtaccggaccccggaacggtccccgtacccggtaccccccgg

SEQ ID NO: 150433 - DNA, 647 bp, Homo sapiens
  misc_feature: GYAE6OF02F78ZQ.48.38.D05.1.454.CMB.1.raw
  modified_base (317)..(317): a, c, t, g, unknown or other
  misc_feature (317)..(317): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtcgtccccaggacagacggccaggatcacgtgctctgcagagacgttgccaagtctaattttggttttgatcagcagaagtcaggccaggccccaagactgctacatgtaatagagacagtgagtacggtccncgaaggactcccgtagagtcgtattctgtcggcctccgagtctcgtcgggaacacacgtcacttcagtacctagtctagtagacggtccggacgtaaggaacggtacggacggtcaacggtaaccttaacgttagttacgtacgtaaggttccgaaggggtaacaaacgtaacgtacccgtcgaccgtaaccgaactaaacggttacgttacgggttaccgggacgggaacgggtaaacccgtaaggtcgtaacggtaaccgtacgggttacccgtaagggtcccgtaaccggaccccggtaacggtcccgtacccggttacccccccgg

SEQ ID NO: 150434 - DNA, 629 bp, Homo sapiens
  misc_feature: GYAE6OF02HHUDD.48.38.D05.1.454.CMB.1.raw
  modified_base (417)..(417): a, c, t, g, unknown or other
  misc_feature (417)..(417): n is a, c, g, or t
tcagagtatacatacacgaccggtgctcgatttagtatctgatagttgggtttgggcacgaccggtgctcgatttagtatctgatagttgggtttgggtggggagcctagctgtgctgtgggtccaggaggcagaactctgggtgtctcaccatggcctggatccctctacttctccccctcctcattctctgcacaggctctgaggcctcctatgaactgacacacgcccacccgtcggtgtcagtcgtcccaggacaggacgccaggatcacgtgctctgcagagacgttcgacctaagtcttaagttttggtttttaggtactcgagcaaggaagtcgacggccacggaccccaagacctgactactatagtaatagagacgtagtggagacgtccgtagacgggtactcccgngacgtcgtattccgtcgtcgtcctccgacgtccgttacggtacgggaaccaccgtacctaccgtaccgtcgttacgaaccgtttactaccgtaaggttacgtaaaccgggtccggaacgtaagggaaccggacggtacggtaccgtaacggtaaccttaacgttacgttacgtacgacggtaccgaagggaacaacgtaacgtaccgtaccg

SEQ ID NO: 150435 - DNA, 519 bp, Homo sapiens
  misc_feature: GYAE6OF02F8QMO.48.38.D05.1.454.CMB.1.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaattttggttttgatcagcagaagtcaggccaggccccaagactgctcatgtatagagacagngagaggtcctcgagggactcccgtgagcgtattctcgtggctccgagctcgtgggacacactcactcngactatcagtgaacggtccgggnaagaagacgaggctagactactagttgtcagtacaggagacaagtactcgacacgacaagtacgtgtcggcggacggaccagcagactacgtcgtaggtacacgaccgaggtcctccggtcccccg

SEQ ID NO: 150436 - DNA, 603 bp, Homo sapiens
  misc_feature: GYAE6OF02II1L7.48.38.D05.1.454.CMB.1.raw
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtctaatttggttttggtatcagcagaagtcaggccaggccccaagactgctcatgtatagagacagtgagaggtcctgagggactcccgtgacgcgtattctcgtcggctccagtctcgtcgggacacactcactctcgactatcagtgaacggtccggganaggaacgacggaggctaggaacttactagttcgtanacggtcaagggactaacgtaataccgtacgacgtaaccgaccttaaaggtaccgttaggttaccgggacgggtaacggggtaccgaagggccgtaacggtacgtaacggttacccgttacgggaccggtaaccggtaccccggaaacgggtcccgtaccggtaccccccgg

SEQ ID NO: 150437 - DNA, 857 bp, Homo sapiens
  misc_feature: GYAE6OF02HD44E.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgaacacagcccaccctcggtgtcagtcgtccccaggacagacggccaggactcacgtgctctgcagagacgttgaccaagtctaagttttgggttttaggtatcgagcaagaagtcaggccacggaccccaagactgctacatgtaatagagacagtgaagtacggtcctacgagggactcccgtagacgacgtacttccgtacgtcggtcctaccgagtccgttacgtacggggaacctaaccgtaccttaccgtaaccgttccgtacgtaaccttaacgttacgtaaacgggttacgggtaaaaccgggttcccggggaacaaacgggtaaaacgggtaaccgggtaacgggtaccgttaacggtaaaaccgttttaaaccgtttaagttttacgggtaaccgttaacggttaccggaaacggggtaaaccgtaaaaccttaaaccggtttaacccggtaacccggtaacccgtaaaaccgggtaacccgtttaaaacggtttaaccggtttaccggggttttaacccgggggaaccgggggtaaaccggggtaaaccccggtaaaagggttacccggtaacggggtaaacccgttaaccgggtttaacccggtttaaacggggttaccccggaaaccggtaacccccgggtaaacggggttccccgttaacccccgggttacccccccccggg

SEQ ID NO: 150438 - DNA, 530 bp, Homo sapiens
  misc_feature: GYAE6OF02HT0XC.48.38.D05.1.454.CMB.1.raw
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtgtccccaggacagacggccaggatcacgtgctctgcagagacgttgccaagtctaatttggttttgatcagcagaatcaggccaggccccaagactgctcatgtatagagacagtgagaggtcctcgagggactccctgagcgattcnctgctcngctcgtggacactacgtcactntgactatcaagtgaagtccgggnaagaagacgagctagaactactattcgnagacaggacgaactaanacctcgacacgactaaagtacgtgttacggacggaagggaaccgtaagctagacgtacgtcctacggtcaccggtacccgaacggtcctccgtacccccg

SEQ ID NO: 150439 - DNA, 467 bp, Homo sapiens
  misc_feature: GYAE6OF02FT6DY.48.38.D05.1.454.CMB.1.raw
  modified_base (278)..(278): a, c, t, g, unknown or other
  misc_feature (278)..(278): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (407)..(411): a, c, t, g, unknown or other
  misc_feature (407)..(411): n is a, c, g, or t
  modified_base (413)..(415): a, c, t, g, unknown or other
  misc_feature (413)..(415): n is a, c, g, or t
  modified_base (417)..(419): a, c, t, g, unknown or other
  misc_feature (417)..(419): n is a, c, g, or t
  modified_base (422)..(467): a, c, t, g, unknown or other
  misc_feature (422)..(467): n is a, c, g, or t
tcagagtatacatacacgaccggtgctcgattttagtatctgatagttggggtttggggggctacgggagggggctaaggttcgaggcaggtggcgccagccaggtgcacacccaatgcccatcgagcccagtacgactggacgctggtaacctcgcggacagtttaaagaacccagggcctctgcgccctgggcccagctctgtcccgacaccgcggtcaccggactggcaccacctctcttgcagcctccacctaagggcccatcggtcttccccnggcaccctctccaagacgcacctcgtggggggaccactagccggccccgtgggctcgccgttggtacgaacggactacgttcctatcgtataccgttctgacggcgggctggacgacggcncatagntnnnnnannnannntannnnnnnnnnnnnnnnnnnnnnnnnnnnnnnnnnnnnnnnnnnnnn

SEQ ID NO: 150440 - DNA, 732 bp, Homo sapiens
  misc_feature: GYAE6OF02H87OT.48.38.D05.1.454.CMB.1.raw
  modified_base (232)..(232): a, c, t, g, unknown or other
  misc_feature (232)..(232): n is a, c, g, or t
tcagagtatacatacacgaccggtgctcgatttagtatctgatagttgggtttgggggtggtccaggaggcagaactctgggtgtctcaccatggcctggatccctctacttctcccctcctcattctctgcacaggctctgaggcctcctatgaactgacacagccaccctcggtgtcagtcgtccccaggacagaccggccaggatccgagtgctctgcagagtacgttnaccaagtctaagttttggttttgatcagcagagtcaggccacggaccccaagactgctacatcgtatagagacaggtgagtacggtcctagagggtacttcccgtagacggtcttattccgtccgtaggtccttcacggtccgttacggtacggggccaacctaccttcctacgttcgtacgaaccttagtacgtaacggtacggtaacggtcccgggaacgaaggaacggaaccgggtaggtaccttaacggaaccctttacgttaagttccgttacgaacggttacgaagggtaaaccgtaaacgtacttaaccggtaccgaaccgtaaccggtaaccgtaaaggtttccggttacggggttacccgggaccggggtaacgggtaaccccgaacgggttaccgtacggtaacccggtaacgttttcccccgggaaggttaccccgaaccgggttaacccccggtaacggttaccccgttaccccccgggtacccccgg

SEQ ID NO: 150441 - DNA, 618 bp, Homo sapiens
  misc_feature: GYAE6OF02GSV8G.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagtctaagttttggtttttggatcagcagaagtcaggccaggcccccaagactgctcatgtactagagacagtgagaggtccagagggactcccgtgacgcgtacttctcgtgtcctccgagcctcgtcgggacactactcacttctagtacttactcgagtagaacgggtccgggacaaaggaacgacggacgggtactacggtaactaacgttagttcgttacgacgttacgaggaacgtaactaacgtaccgtacgaccgacgaaccgtaaacggtacgttgggttaccggacgggtaacggaccgtaacggcctaacggaaccgtagtacccggtaggttccaaccggtccccgaagggtccctcccggtacccccccgg

SEQ ID NO: 150442 - DNA, 733 bp, Homo sapiens
  misc_feature: GYAE6OF02F1EUU.48.38.D05.1.454.CMB.1.raw
  modified_base (301)..(301): a, c, t, g, unknown or other
  misc_feature (301)..(301): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacacgccaccctcggtgtcaggtcgtccccgaggacagaccggccaggactcacgtgctctgacagacgtacgttgacctaagtctaagttttgggttttagatcagcaagagtcgacggccacggaccccaagctnctacatgtactagagactaggtagacgtacggtcctacggaggtacctccgtaggacgtccgttacgttcctacggtcggtaccctccgtacggtcccgttacgggtacggggaacctaactacccttaacccgtacgttaccgtaggtaacttaacgtacgtaacgggtaacgtaaccgggttccggaacgaacgaaacgggtacggaacggtcggttaacgtaacgttaacgtttaacgttccggtaactaacggttaaccgaacgggtaacaaaccgtaacgttaccgtacgaccggttaaccgaagttaacggttacgtacgggttaccggacgggtaacggaaccgtacgtacggtacggtaaccttacgggtaccgtaacggtaccgaaccggtaccggaccgttcccggtacccgttaccccggg

SEQ ID NO: 150443 - DNA, 390 bp, Homo sapiens
  misc_feature: GYAE6OF02HYGT1.48.38.D05.1.454.CMB.1.raw
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (369)..(390): a, c, t, g, unknown or other
  misc_feature (369)..(390): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaaccccaggggcctctgcgccctgggcccagctctgtcccacaccgcggtcacatggcaccacctctcttgcagcctccaccaagggcccatcggtcttccccctggccaccctcctcctaaagagccacctctggggggcacagcggccctggctgcctggtcaaggactacttcctatgtatactctgagcggctggacagcgacanagnannnnnnnnnnnnnnnnnnnnnn

SEQ ID NO: 150444 - DNA, 544 bp, Homo sapiens
  misc_feature: GYAE6OF02H0NE8.48.38.D05.1.454.CMB.1.raw
  modified_base (398)..(398): a, c, t, g, unknown or other
  misc_feature (398)..(398): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaattttggtttttaggtatcagcagaagtcaggccaggccccaagactgctcatgtatagagacagtgagaggtcctcgagggactccgtgacgcgtattctctggactcagctcgtagggacacactcactcagtactatcagtagaacggtccggganaagaacgacggaggtctagactacgttattgtcagtcgaggaacgaacaatacgtacgacacgtacaaagtcgttaggtcggacgggacgggacaacggctaggactacgtacgtacggtcacgacccgaaggcctaccgtccccg

SEQ ID NO: 150445 - DNA, 567 bp, Homo sapiens
  misc_feature: GYAE6OF02FG8RD.48.38.D05.1.454.CMB.1.raw
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacagcccaccctcggtgtcagtgtcccccaggacagaccggccaggatcacgtgctcctgccagagacgttgccaagttcaagtttttgggtttttggtatcagcagaagtcaggcccaggcccccaagactgctcatgtatagagacagtgagtagggtccctacgaggggtactccccgtggaacgtcgtattccgtcgtcggcctccgacgcttcggtgggaaccacacctccaccttcngactatcaggtgaacggtccggganaggaacgacggcggctcactacgttattcgcagtcgaaggacgaacaactacctcgacacgctaagtcgtggtcgggcggacggaccaagctacgactacgtaccgtaggcacggcccaaggcctcccgtccccg

SEQ ID NO: 150446 - DNA, 394 bp, Homo sapiens
  misc_feature: GYAE6OF02G3LAH.48.38.D05.1.454.CMB.1.raw
  modified_base (368)..(368): a, c, t, g, unknown or other
  misc_feature (368)..(368): n is a, c, g, or t
  modified_base (370)..(394): a, c, t, g, unknown or other
  misc_feature (370)..(394): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacacctggacgctgaacctcgcggacagttaaagaacccaggggcctctgcgccctgggcccagctctgtcccacaccgcggtcacatggcaccacctctcttgcagcctccaaccaagggcccaatccggtcttccccctggccaccctcctccaagagcacctctggggcacagcgccctggctgcctggtcaaggactacttcctatgtatactctgagcggctggactaggcgtcataagngnnnnnnnnnnnnnnnnnnnnnnnnn

SEQ ID NO: 150447 - DNA, 620 bp, Homo sapiens
  misc_feature: GYAE6OF02GFMLC.48.38.D05.1.454.CMB.1.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggactggatccctctacttctccccctctcattctctncacaggctctgagcctcctatgaactgacacagcccacccgtcggtgtcagtcgtcccaggacaggacggccaggactcgacgtgctcngcagagacgttgaccaagtctaagttttggttttggtatcagcaagagtcaggccacggacccaagtctgctacattagtataagacgatagtaggagtacggtcctacgagggactcccgtagaccgctattccncgtcggcctcgtacgtacctcgtcggggtaacacccgtactactacccgttcgtaccgactttacgtaacgtaacggttaggtaaacccgggttcggtaaccgaaagggtaacggaccggaggtaccgtaagtaaccgtttaacgttcgttacgtaccgtacggtacggtaacggacctaacgtaaccggttacctaaccgg

SEQ ID NO: 150448 - DNA, 447 bp, Homo sapiens
  misc_feature: GYAE6OF02GUKSB.48.38.D05.1.454.CMB.1.raw
  modified_base (426)..(447): a, c, t, g, unknown or other
  misc_feature (426)..(447): n is a, c, g, or t
tcagagtatacatacacgaccggtgctcgatttagtatctgatagttgggtttggggcagggaggggctaaggtgaggcaggtggcgccagccaggtgcacacccaatgcccatgagccccagacactggacgctgaacctcgcggacagttaagaacccaggggcctctgcgccctgggcccagctctcgtcccacaccgcggtcacatggcaccacctctcttgcacgcctcccaaccgaacgggcccaagtccggtccttccccccgtggccctacccctccttacccaaagtacgtccaacccttcgtgggggacaaccgacggccggtaccccgtgggtcctccggccgttcggtaccaaggccttacttccgtatcgtaactactcgtagacggtcgggctacggtacgaggcgcatagnnnnnnnnnnnnnnnnnnnnnn

SEQ ID NO: 150449 - DNA, 767 bp, Homo sapiens
  misc_feature: GYAE6OF02IDDJ3.48.38.D05.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
tcagagtatacatacacgaccggtgctcgatttagtatctgatagttgggtttgggcacgaccggtgctcgatttagtatctgatagttgggtttggggtggggagcctagctgtgctgtgggtccaggaggcagaactctgggtgtctcaccatggcctggatccctctaccttcctcccctcctctattctctgcacacggtctcgtgacggcctcctatcaactcgacacncgccctaccgtcggtcgtcgtacgtcgtccccgaggtaccacggaccggacgaacggactcgtacgtcgcctcnggacaggacgtagttcgacctaaggttacttaaggttttggttttcggtactcgtgacgtaaggtaagtaccgacggacccgaaccggaaccctaaaggtccttacgaccttacgtaaacgttacggttaaataacgggtaacgtaacgtacgggtaacgtaacggggtcggtttacccgtaggggtaaacccgggtcttacccgggtaggacggtttaaccggttacttctttaccggtcgggaaacccctttcggaaggtttccctaagggttacgggaacccttacgccttaaccgttacccgtacgttaaccgcttaaacgtaccgggaccgtttaaacgggtcgggaaacccgtagaaagggtaacccgtacggggactttacgacggtttaacgttaccggttagtttaccgcgttaggaacggttaacgaacctaacggtctacggaacccg

SEQ ID NO: 150450 - DNA, 709 bp, Homo sapiens
  misc_feature: GYAE6OF02FIQSF.48.38.D05.1.454.CMB.1.raw
  modified_base (145)..(145): a, c, t, g, unknown or other
  misc_feature (145)..(145): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (290)..(290): a, c, t, g, unknown or other
  misc_feature (290)..(290): n is a, c, g, or t
  modified_base (381)..(381): a, c, t, g, unknown or other
  misc_feature (381)..(381): n is a, c, g, or t
  modified_base (463)..(463): a, c, t, g, unknown or other
  misc_feature (463)..(463): n is a, c, g, or t
tcagagtatacatacacgaccggtgctcgatttagtatctgatagttgggtttgggcacgaccggtgctcgatttagtatctgatagttgggtttggggtggggagcctagctgtgctgtggtccaggaggcagaactctgggtntctcaccatggcctggatccctctacttctcccccctctcattctctgcacnggctntgaggcctcctatgactgacacagcccaccctggtntcacgtcgtcccccaggacagaccggaccaggactcgacgtgctctgacagngtacgttcaccaagtctaagttttggttttcgatcgagcagaacgtcgaggtaccacggaccccaagactcgcctttacattacggttaanaggtacgtacgtaggtgaggtaccggtccgttacgagggtactccccgtaggacgccgtattacccgtcgtacggcctcccnggtacccgttcggtacgggaacgtacccaccgttaccgtacttccgtaggtaaccctttacgtacgtaacggttagggtaaacccgggtttaccccggggaacaaacggggttaaaccgggaacccggttggaacccggtttaaacgaacccggtttaaacctttaacgttcggttaaaacccgttacggttaccggaaaaccggggtaactaaaccgtttaaccggttacccccgttaacccggg

SEQ ID NO: 150451 - DNA, 639 bp, Homo sapiens
  misc_feature: GYAE6OF02H1UPA.48.38.D05.1.454.CMB.1.raw
  modified_base (198)..(198): a, c, t, g, unknown or other
  misc_feature (198)..(198): n is a, c, g, or t
  modified_base (324)..(324): a, c, t, g, unknown or other
  misc_feature (324)..(324): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
  modified_base (487)..(487): a, c, t, g, unknown or other
  misc_feature (487)..(487): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgacgcctcctatgaactgacacagccaccctcggtgtcagtcgtccccaggacngaccgcaggatcacgtgctctgacaggagtcgttcgaccaaagttctaagttttggttttagactcagcaagaacgtcgaggacccacggaccccaagtaccgtgcttacatgtaataggagacgnggtagagtgtcctacgaggacttcccgaggtacggtctacttccgtactcggacctaccgagtctacgaggaccactacnctatcgagtactagtcaagtcgtacggccggaanaacggaaagcggagtctactaacgtatagttcgtacaggacgaagaganaacgtactacgactacgactaacgttacgtacgggtaccggagggtaaccggaacctaacggtacgttaggtaaacccgacggtttacccggtaacgggttaaccgaacccggaccccggaaacggttccccgttccccggtaaccccccgg

SEQ ID NO: 150452 - DNA, 597 bp, Homo sapiens
  misc_feature: GYAE6OF02F52B3.48.38.D05.1.454.CMB.1.raw
  modified_base (261)..(261): a, c, t, g, unknown or other
  misc_feature (261)..(261): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgaccaagtctaagttttggttttagatcagnagaagtcaggccacggccccaagactgctcatgtatagagacagtgagacggtcctgagggtactcccgtaggacgcgtatttccgtactcgggcctaccgagtccgttcgtacggggacctacacctcctacgtcctagtactagtacctaggtagaacggtccggagaaggaacgacggacggtctagtacgtacttagttcgtctagtacgaacggtanactagtacncgacacgactaacgtgtcggtacggacgggacggacaggtactacggactacggtaccgttaacggaccgtaccggacccgacggtcccgtacccgtacccccgg

SEQ ID NO: 150453 - DNA, 383 bp, Homo sapiens
  misc_feature: GYAE6OF02GGTJC.48.38.D05.1.454.CMB.1.raw
  modified_base (367)..(383): a, c, t, g, unknown or other
  misc_feature (367)..(383): n is a, c, g, or t
tcagagtatacatacacgaccggtgctcgatttagtatctgatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaagggcccatccggtcttccccctggccaccctcctccaagacgcacctctgggggcacagcggccctgggctgcctggtcaaggctacttcctatgtactactctgagcgggctggcaaggcgcagtagnnnnnnnnnnnnnnnnn

SEQ ID NO: 150454 - DNA, 814 bp, Homo sapiens
  misc_feature: GYAE6OF02HBUSK.48.38.D05.1.454.CMB.1.raw
  modified_base (425)..(425): a, c, t, g, unknown or other
  misc_feature (425)..(425): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacgaggctctggacggcctctagtagaactgacacacgcccacccgttcggtcgtcacggttcccgtacccccgaagggaccaacggacccggaccgaagggtacttaccgaacggtcgtccttcgtacggacgaaggtaacggtaccggtttccgaacccgtaaaaggtttacctttaaggtttttttgggtttttacggtactacgtacggacgtaaaaggtaacgtaccgaaccggacccgaacccggaacccctaaaggccttcgaccttacgtaattagggtaanaaggacgtaacggtaggttacggaacgggtaccgtttccgaacggaacgggtccttacccggtaggaacgtcttacgtttcccgtaggtccggtcctaccgtacggtcgtacgggtacgggaacctacaccgtactacgtcctacgtactacgtacgtaggtaacggacgggtcggaacaaagggaaacgaccgacggtactacgtaactttagttagttcgacgtaagtacggaaacgggtactaaccgttaagtccgacgacgaacgttccgtaaacggttcggttacgggtacgggacgggaaacgaaccgtggtaccgacggtaaccacggttccggtaacggacctaacccggacggtaaccgtcccgtaccccgttccccggg

SEQ ID NO: 150455 - DNA, 854 bp, Homo sapiens
  misc_feature: GYAE6OF02J13H8.48.38.D05.1.454.CMB.1.raw
tcagagtatacatacacgaccggtgctcgatttagtatctgatagttgggtttgggggtgggtccgaggaggcagaactctgggtgtctcaccatggcctggatccctctacttctcccctcctcattctctgcacaggctctgacggcctcctatcgaactgacacacgccaccctcgtgtccagtcgtccccaggacagaccggccaggatcacggtcgccgttctggcctagacgtaccgttcggacccaagtactaagtttttgggttttaggtacttccaggcgtaagtaacggttccgaaggtccccgaacgggaccccccaaagtaaccgtcggacctacctaagttacggtattaaggacggaaccttaggtgaacggtaccgggttacctacggaacgggtaccgtttccccgaggaacgttccgttaaacgtttcccgttacggttaccggggacccttccggtaaacccggtcgttaccccggtagggggtaaaccccgttaccctaaaccgtttcccacccggttttacctacggtaacccttacgtaccgtaaacggtttacggaaacccgggttccgggacgtaaacggtaaccggtaacggtaccgggacttacggaacctttaccgtagttacggtcgtaaacgtcggaaacggtaacgtaacctacgtaaccggtaccgtaaccggttaaccgaaccggtaaccggttaacgtttccggggttaaacggtcgggaacccgggttaactaacgggtacgtacggtaacccgttacgtacccggttaacggtaccgtacccggtaacccggtaaccggcgttaaccccccggtccccgg

SEQ ID NO: 150456 - DNA, 657 bp, Homo sapiens
  misc_feature: GYAE6OF02FHU5B.48.38.D05.1.454.CMB.1.raw
  modified_base (449)..(449): a, c, t, g, unknown or other
  misc_feature (449)..(449): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtcgtcccccaggaccagacggccaggatcacgtgctctgcagacgtacgttgcctaagtctaagtttttgggttttttaggattcgaagtccaagaacgttccgagggcccacgggacccccaaaggacctcgcctcaattacggtatagagaccaggtgaacgtaggtaccctcgaggggtactcccctaggacgtacggtactttaccgtcctggggtcctccgactccgtacgtcggggaccaaccgtacttccgacgttacncgtaactactcagttcggaacgtccgggacaacgaagaccggaggctacgactacttattcgactagacgaaggtaccaactaactactacggacaaccgcgtaaacgtcgtacgggttacggacgggacggtaaccgaacggtcgtacgtaacgaccgttacgtacggacctaccggacccgaaccggtccgtacccggtacccccg

SEQ ID NO: 150457 - DNA, 784 bp, Homo sapiens
  misc_feature: GYAE6OF02HDW14.48.38.D05.1.454.CMB.1.raw
tcagagtatacatacacgaccggtgctcgatttagtatctgatagttggggtttgggggtgggtccaggaggcagaactctgggtgtctcaccatggcctggatccctctacttctccccctcctcattctctgcacaggctctgaggcctcctatgaactgacacagcccaccctcggtgtcagtcgtccccaggacaggacggccaggactcacgtgctactgcagagtacgttgacccaaagttctaaagttttgggttttaggaattcagtcaaggaagtcgaggccacgggaccccctaaagactcgacctctaagtacgtaagtaagaacgacgtaaggtaggaacggtacgggttaccctaacggagggggtacccttaccccgtagggaacgtaccggtaatttccgtccgttagggacccttccgtaaggtccctcggttacgggaacccgaacctaacctcgaccgttacgtacgacctaacgtaccgtaaggtacggtaaacggtcccgggaaataacggaaacggtaacggacggtaccgttaggtaaaccttacgttaacgttacgtacggtaagtacggaaacggaacggtaaacctaaacgtaccgtacggaacccgacgggttaaaccgaaacggtttaaccgtacggggtaccggggaccggggaacggtaacccggtaaggtacccgtaacggtaaccgtaacggttaccgaaccggttaccgaaccggttaccccggaaggttccccgtacccggtaccccccgg

SEQ ID NO: 150458 - DNA, 758 bp, Homo sapiens
  misc_feature: GYAE6OF02ICILR.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtgtcagtgtccccaggacacgacggccaggatcgacgtgctctgcagacgacgttcgacctaagttcctaagtttttggggttttttaggattcgaagtacaaggtaaacggttcgaacggggacctacgggtaccccccgaaaggtacctggcctctaattcggttaaactaggaagtaaccgtagggtacggaacggacgggttacccgtacggaacggggtacttccccggtaggacggtccgtaatttccgtacgttcggacctcccgagtccgttcggtacggggaacccaaccgtacctcgaaccttccgttacgaacttacgttccgtaagggttacgtaaaccgggtcccgggactaacgggaaacggtacggacggtccgtagtaccttaactagtttcgacgtaggtacgaacggacgtaaacctaacgttaccgtacggaccgacgtaacgtaaacggttaccgttcgggttacgggaccgggtaacgggacccgtaaggtccgttaggaacctacggttaccgtacgggtacctaccggacccgtaacggcccttacccggtcccccg

SEQ ID NO: 150459 - DNA, 775 bp, Homo sapiens
  misc_feature: GYAE6OF02IBV8J.48.38.D05.1.454.CMB.1.raw
tcagagtatacatacacgaccggtgctcgatttagtatctgatagttggggtttgggggtgggtccaggaggcagaactctgggtgtctcaccatggcctggatccctctacttcctccccctcctcattctctgcacaggctctgagcctcctatgaactgacacagccctacccgtcggtgtcagtcgtaccccaggacacggacggccaggatccacgtgtctctgcagacgtacgttcgacctaagtcttaagtttttcggttttgactccgagacaaggtaagtcgacgggcccaacggaccccccaaaggtcctcgtacctacgtaagttacgttacgaaaggtacgaacgtacggttggaaacggtaccgggtcccgtaacgggtaacggggtaccttcccggtaggaccggtaccgttacgtttcccgtcgtaccgggcccttaccgaggttcccgttacggtacccgggaactaccctactcctaccgtcgtactacttacgtacgtacggtacgggaccggtaccgggagtaacggacgtacgggacgtacctacgtactttaccgtagtttacgcgtaacgtacggaagaacgtaactaccgtacgaccggtaaccgacgtaacgtttaaccggttaccggttacgggtcgggaacggggtaccgtaacggtacctaggtaaccgtaacgttaccggtaccggtaaccggttacccggaaccggttacccccggaacgggttccccgttccccggtacccccgg

SEQ ID NO: 150460 - DNA, 717 bp, Homo sapiens
  misc_feature: GYAE6OF02ITK5X.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgacggcctctatgaactgacacacgcccaccctcggtgtcagtcgtcccaggacaggaccggccaggactcgacgtgctctgacagagtacgttgaccaagtcttaagttttggttttgtactcagcagtaagtcgacggcaccgaccccgaagactcgtctctagtagtataggaacgtacgtaggtagaggtacggtccgtacggtacggggtaacctttcccgaggacggtacgtagtttcccgttacggtcggtcccgtaccgacggtccgttccggtaacggggaaccaccgtaccttccaccgttctaacggtacttacgtacgtaacggtacggaacgggtccggaagaacggaaacggcggaggtctaacgttacctagttacgtacgttacgacgtacgaaggaactaacgtaaatacccgtactaaccggacgtaaccggaaacgttccgttacggggtacgggacgggtaacccggacgtaacggtcgtacgggtaaccgtacggttaaccgtacgggtaccgaccggtacccggaacggtccccggtcccggtacccccggg

SEQ ID NO: 150461 - DNA, 662 bp, Homo sapiens
  misc_feature: GYAE6OF02IN7GA.48.38.D05.1.454.CMB.1.raw
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagagtatacatacacgaccggtgctcgatttagtatctgatagttgggtttgggggtgggtccaggaggcagaactctgggtgtctcaccatcggcctggactccctctacttcctccccctctcattcctctgcacagctctgacgcctctatgaactgacacgacgcctacccgtggtgtcagtcgcccaggacagcgcaggatcacgtgctcngcagatacgttcgaccaagtctaagttttggttttcgaatcagcaagacgtcaaggccagacccagacctgcngatnatacncgaatgtnagcgtaccngaagctccgtagacgtnttcgtctcgaacggtcctacgagtcctcggaacggacctactaaggccctaacggttctggtacttacgaccgttagtaaccgggtaacggtccggganaaacggganaccggttaaggctaaacgtcttaaggtttcacggttaccaggttaccgaagtaaacgaccttaacgtacgccgaaacgtcccgaaacgttacgaacgggtttcggtaacccgggacggggtaaccggtaacgaaccggtttacgacggaaccgtttaaaccggtccggaaacccgttcggaaacccgccggtaaagggtttcccgaaccccttcccccgg

SEQ ID NO: 150462 - DNA, 807 bp, Homo sapiens
  misc_feature: GYAE6OF02JQUNZ.48.38.D05.1.454.CMB.1.raw
  modified_base (233)..(233): a, c, t, g, unknown or other
  misc_feature (233)..(233): n is a, c, g, or t
tcagagtatacatacacgaccggtgctcgatttagtatctgatagttgggtttgggggtggggtccgaggaggcagaactctgggtgtctcaccatggcctggatccctctacttcctccccctcctcattctctgcacaggctctgacggcctcctatgaactgacacgacgcccacccgtcggttgtctaggtcgtaccccgaggacaggaccggccgaggtatcacggtnctctgcagagtacgtcgacagtctagtttggtttgtactgacgtacaggtaacgtacgacgggtacccgaccgggacccccaaaggtacctggacctcgtaacgtggtaagtacggacggtaacgacggttaagggacgtacgggtcccctaagggtacgggtacttccccggtaggaaccggtacgtaccgttacgtccgtcggtacccgtcccgaagtcccgtacgggtacgggtaccaaccgtacttaccgtaccgttcgtaacgtacttacggtaccgtaaggtaacgggtaccgggtaccggacgtaaacggaagtacccgggacggtaacgacgttaaccgtttacggtaacttcggtactaacggacggttaaacggtaaccgaaccttaacggttacccgaacgggtacctaaccgggtaacgtaaccggtaaccgttcggggtaacccggggacggtaaccgggaaccctacggggtaacttccgggaacgtacccgggtttaaccgttcgggaacccttacccgggaaccccgggtaagtaccccggtcccggtaaacccccgg

SEQ ID NO: 150463 - DNA, 654 bp, Homo sapiens
  misc_feature: GYAE6OF02G4B8Y.48.38.D05.1.454.CMB.1.raw
  modified_base (180)..(180): a, c, t, g, unknown or other
  misc_feature (180)..(180): n is a, c, g, or t
  modified_base (364)..(364): a, c, t, g, unknown or other
  misc_feature (364)..(364): n is a, c, g, or t
  modified_base (593)..(593): a, c, t, g, unknown or other
  misc_feature (593)..(593): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagcccaccctcggtntcagtcgtccccaggacagacggccaggatcacgtgctctgcagagacgttgccaagtctaagttttggttttgtatcagcaagaagtcgaggtccaacgggtccccaagactcgcctctagtacgtataagagacgaggtggaagtcggtcctgagggtctccgagacgtcgtacttcgtcgnggcctcgacgtcgtggtcgggaacctactaccgtctaccttcgtacgtactaacgtacgtaggttacggaaaccggttcgggaacgaaggaaacggacggacggaccgttagaaccgtttacttagttcgtacgtaaggttacgaacgggaaacaaccttaagtaccctacggaacgactaccgtaaaggtaccgttaggggtaccggacggggtaacgaccgtaacgngtaacggacgttcggaaccgttaggtaccaccggaccctaggtcccgaccccgttccccgg

SEQ ID NO: 150464 - DNA, 624 bp, Homo sapiens
  misc_feature: GYAE6OF02HLD2O.48.38.D05.1.454.CMB.1.raw
  modified_base (178)..(178): a, c, t, g, unknown or other
  misc_feature (178)..(178): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (510)..(510): a, c, t, g, unknown or other
  misc_feature (510)..(510): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccacccgtggtntcagtcgtccccaggacagcgccaggatcacgtgctctgcagagtacgtgaccaatctaatttttggttttgatcgagtcaagtaacgtcaggccacggaccccaagtactgacctacagttgatagacganaggtgagtacggtctcgaggccttccgngacgctacttcncgtcggcctacncgtctacgacgggacaccgtcgcacgttctacgtactacgtcgagtacggacgggtcccggagaaacgaacggtacggagtaccttacggtaacttacgttgttacgtcgaagtacggaaggaacctaacgtaactaccgccggtaanaaccgggttactaaacggttacgggttcgggtaaccgggaccgggtaaggaccgaacgtcgtaacgacgtcggttaacgtcgtacgacggacccgacggttccgccccgtcccg

SEQ ID NO: 150465 - DNA, 941 bp, Homo sapiens
  misc_feature: GYAE6OF02JK42W.48.38.D05.1.454.CMB.1.raw
  modified_base (493)..(493): a, c, t, g, unknown or other
  misc_feature (493)..(493): n is a, c, g, or t
  modified_base (549)..(549): a, c, t, g, unknown or other
  misc_feature (549)..(549): n is a, c, g, or t
tcagagtatacatacacgaccggtgctcgatttagtatctgatagttgggtttgggggtgggtccaggaggcagaactctgggtgtctcaccatggcctggatccctctacttctccccctctcattcctctgacagtacgctcgtggacggtcctcctatacgaacctgaccacacgtccctacccgtgggtctacgacggttccgaccccgaaggtacgacggtaccggccgaaggttcaccgtacggtcgtccttacgtcgaccgaaggttacgacggtttccggaaccttaggttaaccttttaagggttttttcgggttttggtaactcgatacgtaagtaacgtacggacggcccgaaccggaccccgtaagaccgtacgtcctagtataagtgtaagacgacgaggtacggtaacggttcgtaccgtacggtacgggtacctcccgtaaggtccggtcttaaccgtttgtacccggttcgtaaccnccccgtagtcccggttacggacggggtaaccctaccacccggttcctaccgtttanaacccggttataaccgttaccggtaacggtttaaccgggaaccgggttacccgggtaacgggtaaacggtaaaccgggaacgggtaaccgttaccggttaaccgggtttaacctttaacccgttttagttaccggtttaaaccgtaacgggtttacggaaacgggggtttaaccaaaaccgttaccgttaaccggtaacccgggttaaccgaaccgggtaaaccgttaaaccggttaaccggttacccgggggtttaacgggacccggggtttaaaccggaaaccggtaacggttaacccttaacggggtaaccgttaccggttaccgttacccggggaaccggttaccggaacccgggtaaccgtccccggttaccccggttaacccccgg

SEQ ID NO: 150466 - DNA, 697 bp, Homo sapiens
  misc_feature: GYAE6OF02H70MY.48.38.D05.1.454.CMB.1.raw
  modified_base (220)..(220): a, c, t, g, unknown or other
  misc_feature (220)..(220): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgaggcctcctatgaactgacacacgcccaccctggtgtcagtcgtccccaggacaggaccggccaggatcgacgtnctctgcagagtacgttcgaccaagttcttaagtttttcggtttttaggtactacgaggtacctaagtaaacggttcgaacgggtaccccgaacgggaaccccccaaaggtacctcggccttaacgatacgtttaagacgtaaggtaccgagggttaggacggacggggttccctacggtaagggtacccgttacctaggaccgtcgtactttccgtacgtggccttcgagtccgttcggacgggactaccacttccacgttcgtcgtaacctgtacaggtagtacggtcgggaacgaggaacggacggacgtcgacgtaattacgtattgtcgagtacgaggtacgaacgtcgtacctgaccgacgagtaacgttaccgttgggtaccggacgggacggtaacgcgtacgacggtacggttacctaccggtacggtacccgaccggtaccggaacggtcccgtacccgtacccccgg

SEQ ID NO: 150467 - DNA, 859 bp, Homo sapiens
  misc_feature: GYAE6OF02JODF8.48.38.D05.1.454.CMB.1.raw
  modified_base (177)..(177): a, c, t, g, unknown or other
  misc_feature (177)..(177): n is a, c, g, or t
tcagagtatacatacacgaccggtgctcgatttagtatctgatagttgggtttgggggtgggtccaggaggcagaactctgggtgtctcaccatggcctggatccctctacttcctcccccctcctcatttctctgcacgagtctctgaggcctcctatcgaactgacacacgcccncccttcggtcgtcgacgttccgacccccgaggaccacggcccgacgtaggacttcgaacggtcggcctcgtcgacacggaacgttccggttacaccgtaagttacgttaagttttttcgggttttacggtacttaccgaggacctaaggtaactccggtaagggacccccaccggaccccctaaagtccgttcgcccgttacgtatttaggaacgttagaacgacggttagacggtaaggtccgtaccttaccgggaacggtaccttccggtaggaactcgttacgttccgttcggaccggtaccttaccgacggtttccgtacggtacggtaacccaccgtacgtcctaaccgtcgtaacgtactacggtcaaggttacggtaccggtcgacgtaaggaccggtaagtaccgggtctaacgggttacctacggttaacttcccgtagtaacggtaccggtaaacgaacccgttaccgaaaaacgtttccgacccggtacggtaaaccccgggtttaaagaaaaccgggttttccccggttaacgggggtttacccgaaaccggggaacgggtaaacccgttaaccggtaacggtttaccgaaaccgtttaacccgggtaccgtacggtttaacccgacccggttacccggtaacggtaccccgttcccccggttaccccgg

SEQ ID NO: 150468 - DNA, 696 bp, Homo sapiens
  misc_feature: GYAE6OF02GBUUW.48.38.D05.1.454.CMB.1.raw
  modified_base (182)..(182): a, c, t, g, unknown or other
  misc_feature (182)..(182): n is a, c, g, or t
  modified_base (224)..(224): a, c, t, g, unknown or other
  misc_feature (224)..(224): n is a, c, g, or t
  modified_base (332)..(332): a, c, t, g, unknown or other
  misc_feature (332)..(332): n is a, c, g, or t
  modified_base (552)..(552): a, c, t, g, unknown or other
  misc_feature (552)..(552): n is a, c, g, or t
tcagagtatacatacacgaccggtgctcgatttagtatctgatagttgggtttgggggtgggtccaggaggcagaactctgggtgtctcacatggcctggatcctctacttctccccctcctcattctctgccacaggctctgacgcctctagtgaactgacacacgccctacccgtcggtntcaagtccgtaccccaggtacagaccgcctaggactcagtcncttctagcagacgtacgttcgactaagttacttaagttttggttttacgatacagctaaggtaacgtcaacggccgtaaccggacccctaagaccttagacccgttanaacgttgtaaacgaacgtaaggtaaccgtaggtcggtaaacgtaccgtacgtacggacggtactacccgttagacgtgtaacttcgtactcgacctacgtacgtctcgggacggtaacctacgaccgttacctacgttccgtaacactaacgtctaaggacggtaccggggtacacgtaaacggaacggtcggaagtaccggtaacaacgtttacgttanccgttaacgacgttaggaacgacaacggttacaccgtcgaacgacgaacttacggtacgcgttaccgggacgtaacgacggtaacagtaacgacgtaaccgtggaaccgtactaccggactaaccggtccgtacccgtaacccg

SEQ ID NO: 150469 - DNA, 842 bp, Homo sapiens
  misc_feature: GYAE6OF02JFG87.48.38.D05.1.454.CMB.1.raw
  modified_base (141)..(141): a, c, t, g, unknown or other
  misc_feature (141)..(141): n is a, c, g, or t
tcagagtatacatacacgaccggtgctcgatttagtatctgatagttgggtttgggggtgggtccaggaggcagaactctgggtgtctcaccatggcctggatccctctacttctcccctcctcattctctgcacaggctntgaggcctcctatgaactgacacagccacccgtcggtgtcagtcgtccccaggacagacggcaggactcacgtcgtctcgtcgcaggagtacgttcgcctaagttctaagttttcggttttgtatcagacagaagtcacggccaacggccccaagctgactgatgtaactaggacgacgagtgacgtacggtcctacgagggtaccttacccgtaggacgtacggtacttcgtacgtcggtctaccgcgtacgttcggtcggaacgtacctacttccgaccgttcgtaacgtacctaacgttcgtaacggttacgggaaaccggttccgggaacgtaacgggtaaacgacgggaacggttaaccttaacggtaccgtttaaacgttacggtttacctaaccggtaaccggtaccggtaaaacgggtaaccggttaaacccggtaaacgtttaaccccggggtaaccggtaaccccgggtaaaacccgttaaccccgggttaaaaacggttttacccggggtttacccgggggtttacccggggaaacccgggggtaaacccgggggtaaccgtaaacccggggtaaccggttaaccggttaaccggaacccggggttttaccccgtacggggttaaacccggaaccccggtaacccgggttaaccggggtaccccccgttaccccgggtaacccccccggg

SEQ ID NO: 150470 - DNA, 798 bp, Homo sapiens
  misc_feature: GYAE6OF02G3SHJ.48.38.D05.1.454.CMB.1.raw
  modified_base (156)..(156): a, c, t, g, unknown or other
  misc_feature (156)..(156): n is a, c, g, or t
  modified_base (180)..(180): a, c, t, g, unknown or other
  misc_feature (180)..(180): n is a, c, g, or t
tcagagtatacatacacgaccggtgctcgatttagtatctgatagttgggtttgggggtgggtccaggaggcagaactctgggtgtactcaccatggcctggatccctctacttctccccctcctcattctctgcacaggctctgagcctcctagngaactgacacagccacccgtggtntcagtcgtaccccaggacacggacgccaggatcacgtgcctcgtgcagacgtcgttacgactaagttactaagtttttgggttttagtacttacgacacgtaagtaacggtaccacggtaacccgaccggaaccccgaagacgtacgtcctactagttacggtaataaggaactaacggaggttaaggacggtaccggttacctaccggaaaggggttacccttaccccggtaggaccgacgttccgtttaccgttacggtacgcccgttaaccggtcgtaccgtaccggtacgggtaaccgtacccgtacctactaccttacggtactaccgttacgtacgtaacgggtacggtaaacccgggaccggtaaacggaacggtaacgacggtaccgggtacttaacgttaaccgtattacggtttataacccgtagtaacggaacgtaacggtactaaaccgtccgttaaccgaccgtacgtaaccgttaaacgttaccggtcggttacccggggacgggaccggtaaccggtacgtaaccggtaacgtaacccggtacgtttaaccggaccgttacccggtaaccggcccggaacggtccccgtacccgtaaccccgg

SEQ ID NO: 150471 - DNA, 696 bp, Homo sapiens
  misc_feature: GYAE6OF02GM5KX.48.38.D05.1.454.CMB.1.raw
  modified_base (287)..(287): a, c, t, g, unknown or other
  misc_feature (287)..(287): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctggaggcctacctagtcgaactgacacgacgcccacccgttggtgtcaggtccgtccccgaaggaccaggacgccaggactccgacgtgctcgtcgctagacgtacggttgacctaagtcttaaagttttgggttttacgatcgngtcgagagtcacggccaggacccccaagactcgctacatagtagagagacgagtgagcggtcgtcgaggactccgngacgngtacttacgtcgtaggtcctaccgagtcccgttaggtacgggtacgactaccggtctaccggttccaggtacctacgtaccgtacggtaaggaaccgggttcggaacgaacgggtaacgacgggacggtctacggttaacctacgttaacgttcgaacgtacttaccggaagtaaccgaacttaacgtaccgttacgaccgtaacgaaccgtaaacggtttccgacgggttaccgggacggtacgggtaacgaacggtacgaaggtaccgacgtttaccgggaacgttacggaccccgtaaccgtcggtaccctcccgtacccccggg

SEQ ID NO: 150472 - DNA, 834 bp, Homo sapiens
  misc_feature: GYAE6OF02JY4U0.48.38.D05.1.454.CMB.1.raw
  modified_base (409)..(409): a, c, t, g, unknown or other
  misc_feature (409)..(409): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (780)..(780): a, c, t, g, unknown or other
  misc_feature (780)..(780): n is a, c, g, or t
tcagagtatacatacacgaccggtgctcgatttagtatctgatagttgggtttgggggtgggtccaggaggcagaactctgggtgtctcaccatggcctggatccctctacttcctccccctcctcattctctgcacaggctctgacggtccctcctatgaactgacacagtcccacccgtcggtagtcacggttccgcccccgaaggaccgacggaccggacccaacgggtataccgaccgtgacccttcctggaccgaggtaacggttacgttaccgggaccctaaaaggttcctttaaaacgggttttttggggtttttttaggaactttccgtaaggtccgaaaggtaaaccgtgaaccgggtaccaacccggggtacccccaaggtacctacggtcccttaagngttaaaccgggattaccggaagaccgttaaggagacgggtaacgtttcccacgggaacggttacgtcccggttagcgtaccggtatccgtttcgaccgggttccnccgagttcccgngttaaccgggaacgtaccacccttctacggtaacttcgtaacgtacgtaccgtagtaaggtacccggttaccggggaaccgaaacggtaacggaaccgggtaggtaccggtaaccgtacgtttaaccttagggttacgtaaccgttacgaccggttaacggaccggtaaaactacgtaacccgttacgaacgtaccgtaaccggtacggttatacccgggtagggtaccgggcgggtaaccgacgtacgacganaccggttacgacggtccgaaccggttccaacggtaccccgttccgtaaccccgg

SEQ ID NO: 150473 - DNA, 742 bp, Homo sapiens
  misc_feature: GYAE6OF02JJK55.48.38.D05.1.454.CMB.1.raw
  modified_base (211)..(211): a, c, t, g, unknown or other
  misc_feature (211)..(211): n is a, c, g, or t
  modified_base (411)..(411): a, c, t, g, unknown or other
  misc_feature (411)..(411): n is a, c, g, or t
tcagagtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacacgccctacctggtgtcagtcgtacccgaggacagacggccaggtntaccgacgtcgctcgtcgacgaagtacgacggttcgaccctaagttactaagtttttcgggttttagatccagtcgtaacgagtacacggaccgaacggtacccaagactcgctacatcgtaagtagacacgagtacgagtacgtcctagacggtactaccgtgacgtcgtacttacgtcgtacgctacgagtcgtacgngggaacctactacgtactaaccgtctcgtaactagtacgtacgtacggtaaccggtaccggaacaaggtacggacgtacgctaacggttactacgttacgtaggtacctaggtaaccgaggaaacctacgtaacttaaccgtccggaactaacgtaaccgttaaacggttacgtacccgggtttaccgggaccggggttaaacggacccgtttaaagggttaacccgacggtttaaaacccggaaccgggttttcccgtaaaaccgggtaccggtaaaccccggtaaccccggtacgggttaccccggttaccccccggttaaacccccgg

SEQ ID NO: 150474 - DNA, 682 bp, Homo sapiens
  misc_feature: GYAE6OF02G0ZX1.48.38.D05.1.454.CMB.1.raw
  modified_base (182)..(182): a, c, t, g, unknown or other
  misc_feature (182)..(182): n is a, c, g, or t
tcagagtatacatacacgaccggtgctcgatttagtatctgatagttgggtttgggggtgggtccaggaggcagaactctgggtgtctcaccatggcctggatccctctacttcctccccctctcattctctgcacaggctctggaggcctcctaatgaactgacacagcccaccctgggtntcagtcgtcccccaggacaggaccggccaggatcacgtgcctctgccaggacgtacgttgaccaagttctaagtttttggtttttaggatcagcaagaagtcaggcccacggacccccaagactgctacattgtataggagacaggtgaggtacggtcccgtgacggggactaccccgtaggacgtctatttctacgtcggcctaccagtcccgttcggtagggaacctacccgttacctacctaccttccgtacgtaacctttagtaccgacggttacggaaccgggttccgggaaccgtaaggaaacgtaacggacggtacgtacggtaaactaccggttattacgtacgtacgacgacggaataaccgaaactaccgtacgtaccgaaccgtaacgtaacgttaccgtcgggttacgggacgggaccggtaacgcggtactacggaccgtacgtaccggtacgtccaacggacccgtacggtcctcccggtacccgg

SEQ ID NO: 150475 - DNA, 741 bp, Homo sapiens
  misc_feature: GYAE6OF02FITZO.48.38.D05.1.454.CMB.1.raw
tcagagtatacatacacgaccggtgctcgatttagtatctgatagttgggtttgggggtgggtccaggaggcagaactctgggtgtctcaccatggcctggatccctctacttctccccctcctcattctctgcacaggctctgagcctcctatgaactgacacacgccaccctcggtagccagtcgtccccaggaccacggaccggccaggactaccacgtgctccgtgccagacgacgttcgaccgtaagtctaagtttttgggtttttaggacttccgagtaccaaggtaaacggttccgacgggaccccgtaaccgggaccccccgaaaagaccttaggcctactagtacgtatagagtaacgagttagacgtacggtccgtacgtaacgggactcccggtagacgtacgtattccgtcgtcgtccttaccgcgtcgtcgtagggaccaaccacctcgactcgacgtactagtaccgaggtacgtaaccgggtaccgggacgaaacggaaggaaccggaggtaccgtgtaaaccttaacgttacgtttacgacgtaacggtgtaaacggtacgaaacaacgtaccgtacgaaccgaaccgtaaacgaaccggtacgttacgggtaccgggacgggtaaaccggacggtaacggtactaccggtaaacggtaccgttaaccgggtacggttacgaaccccggttcccgaaaccgggttccgtaaccccggtcccccgg

SEQ ID NO: 150476 - DNA, 173 bp, Homo sapiens
  misc_feature: GYAE6OF01BWAUH.13.86.H09.1.454.CMB.1.raw
  modified_base (169)..(173): a, c, t, g, unknown or other
  misc_feature (169)..(173): n is a, c, g, or t
tcagtcacgtactacacgaccggtgctcgatttagtgctatagacttgggttggggaagaggaagactgacggtccccaggagttcaggtgctgggcacagcggccctgggctgcctggtcaaggactacttcctagtcgtgactgagcgggctggcaaggcgcatagnnnnn

SEQ ID NO: 150477 - DNA, 190 bp, Homo sapiens
  misc_feature: GYAE6OF01BFHYE.13.86.H09.1.454.CMB.1.raw
  modified_base (173)..(190): a, c, t, g, unknown or other
  misc_feature (173)..(190): n is a, c, g, or t
tcagtcacgtactacacgaccggtgctcgatttagtgctatagacttgggtttggggaaggaggaatactgacggtccccaggagttcaggtgctgggcacagcggccctgggctgcctggtcaaggactacttcctagtacgtgactgagcgggctggctaaggcgcatagnnnnnnnnnnnnnnnnnn

SEQ ID NO: 150478 - DNA, 174 bp, Homo sapiens
  misc_feature: GYAE6OF01DLAMY.13.86.H09.1.454.CMB.1.raw
  modified_base (173)..(174): a, c, t, g, unknown or other
  misc_feature (173)..(174): n is a, c, g, or t
tcagtcacgtactacacgaccggtgctcgatttagtgctatagacttgggtttgggtgtcttcggcggagggaccaagctgaccgtccttcgtcagcccaaggctgccccctcggtcactctgttcccaccctcctctagtacgtgactgagcgggctggcaaggcgcatagnn

SEQ ID NO: 150479 - DNA, 172 bp, Homo sapiens
  misc_feature: GYAE6OF01CGQCH.13.86.H09.1.454.CMB.1.raw
  modified_base (172)..(172): a, c, t, g, unknown or other
  misc_feature (172)..(172): n is a, c, g, or t
tcagtcacgtactacacgaccggtgctcgatttagtgctatagacttgggtttggggaagaggaagactgacggtcccccaggagttcaggtgctgggcacagcggccctgggctgcctggtcaaggactacttcctagtacgtgactgagcgggctggcaaggcgcatagn

SEQ ID NO: 150480 - DNA, 174 bp, Homo sapiens
  misc_feature: GYAE6OF01CLZEE.13.86.H09.1.454.CMB.1.raw
  modified_base (173)..(174): a, c, t, g, unknown or other
  misc_feature (173)..(174): n is a, c, g, or t
tcagtcacgtactacacgaccggtgctcgatttagtgctatagacttgggtttgggtgtcttcggcggagggaccaagctgaccgtccttcgtcagcccaaggctgccccctcggtcactctgttcccgccctcctctagtacgtgactgagcgggctggcaaggcgcatagnn

SEQ ID NO: 150481 - DNA, 173 bp, Homo sapiens
  misc_feature: GYAE6OF01DJIGQ.13.86.H09.1.454.CMB.1.raw
  modified_base (173)..(173): a, c, t, g, unknown or other
  misc_feature (173)..(173): n is a, c, g, or t
tcagtcacgtactacacgaccggtgctcgatttagtgctatagacttgggtttgggtgtcttcggcggagggaccaagctgaccgtccttcgtcagcccaaggctgccccctcggtcactctgttcccgccctcctctagtacgtgactgagcgggctggcaaggcgcatagn

SEQ ID NO: 150482 - DNA, 175 bp, Homo sapiens
  misc_feature: GYAE6OF01A97M9.13.86.H09.1.454.CMB.1.raw
  modified_base (173)..(175): a, c, t, g, unknown or other
  misc_feature (173)..(175): n is a, c, g, or t
tcagtcacgtactacacgaccggtgctcgatttagtgctatagacttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 150483 - DNA, 175 bp, Homo sapiens
  misc_feature: GYAE6OF01A197R.13.86.H09.1.454.CMB.1.raw
  modified_base (173)..(175): a, c, t, g, unknown or other
  misc_feature (173)..(175): n is a, c, g, or t
tcagtcacgtactacacgaccggtgctcgatttagtgctatagacttgggtttgggtgtcttcggcggagggaccaagctgaccgtccttcgtcagcccaaggctgcccccctggtcactctgttcccaccctcctctagtacgtgactgagcgggctggcaaggcgcatagnnn

SEQ ID NO: 150484 - DNA, 195 bp, Homo sapiens
  misc_feature: GYAE6OF01EXBAF.13.86.H09.1.454.CMB.1.raw
  modified_base (173)..(195): a, c, t, g, unknown or other
  misc_feature (173)..(195): n is a, c, g, or t
tcagtcacgtactacacgaccggtgctcgatttagtgctatagacttgggtttggggtgtcttcggcggagggaccaagctgaccgtccttcgtcagcccaaggctgccccctggtcactctgttcccgccctcctctagtacgtgactgagcgggctggcaaggcgcatagnnnnnnnnnnnnnnnnnnnnnnn

SEQ ID NO: 150485 - DNA, 497 bp, Homo sapiens
  misc_feature: GYAE6OF01AD619.13.86.H09.1.454.CMB.1.raw
  modified_base (489)..(489): a, c, t, g, unknown or other
  misc_feature (489)..(489): n is a, c, g, or t
tcagtcacgtactacacgaccggtgctcgatttagtgctatagacttgggtttggggacccaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctgggacgaggactcgagtggatgggatggatcagcccttacaacggaacacagactatggacagaacctccaggcagattcaccatgacgacagacacatacacgaacacagcctacatggagtgaggagcctgagatatgacgacgacggcgtagtattatgtgcgagagtggagtggcagtggatagtcgaataattntacttaag

SEQ ID NO: 150486 - DNA, 509 bp, Homo sapiens
  misc_feature: GYAE6OF01BUZ69.13.86.H09.1.454.CMB.1.raw
  modified_base (339)..(339): a, c, t, g, unknown or other
  misc_feature (339)..(339): n is a, c, g, or t
  modified_base (410)..(410): a, c, t, g, unknown or other
  misc_feature (410)..(410): n is a, c, g, or t
  modified_base (497)..(497): a, c, t, g, unknown or other
  misc_feature (497)..(497): n is a, c, g, or t
tcagtcacgtactacacgaccggtgctcgatttagtgctatagacttgggtttggggacccaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacactttagcagctatcttatcagctgggtgcgacaggcccctggacgagaactcgagtggatgggatggatcagcccttaacgaacggaaanacagactataggacagaacctcagggcagattcaccatgacgacagacacatacacgaacacacgacctanacgtggaggtagaggagcctagaagatagtagacgacgacgcgtagtatagtgtgcgagaggtggagtggcgagtaggatagcgaanaacttgtgtacg

SEQ ID NO: 150487 - DNA, 174 bp, Homo sapiens; identical to SEQ ID NO: 150480
  misc_feature: GYAE6OF01C29ST.13.86.H09.1.454.CMB.1.raw
  modified_base (173)..(174): a, c, t, g, unknown or other
  misc_feature (173)..(174): n is a, c, g, or t

SEQ ID NO: 150488 - DNA, 174 bp, Homo sapiens
  misc_feature: GYAE6OF01EVZA2.13.86.H09.1.454.CMB.1.raw
  modified_base (174)..(174): a, c, t, g, unknown or other
  misc_feature (174)..(174): n is a, c, g, or t
tcagtcacgtactacacgaccggtgctcgatttagtgctatagacttgggtttgggggaagaggaagactgacggtccccccaggagttcaggtgctgggcacagcggccctgggctgcctggtcaaggactacttcctagtacgtgactgagcgggctggcaaggcgcatagn

SEQ ID NO: 150489 - DNA, 566 bp, Homo sapiens
  misc_feature: GYAE6OF01EQHEQ.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggctggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttaacaacggaaacacagactatggacagaacctcgaggcagatcaccatagacgacagacacatacacgaacacagacctacagtggaggtgaggagcctaggacgagtaatggaacgacgaccggtccgtagtacttagttggtaggaccgaaggtacgggtgggaaggttcgggacgtaagggttagggtaacttacgtaaccggtaaacgtaaaactttaaccgtaaactttaaacg

SEQ ID NO: 150490 - DNA, 174 bp, Homo sapiens
  misc_feature: GYAE6OF01CARQP.13.86.H09.1.454.CMB.1.raw
  modified_base (173)..(174): a, c, t, g, unknown or other
  misc_feature (173)..(174): n is a, c, g, or t
tcagtcacgtactacacgaccggtgctcgatttagtgctatagacttgggtttggttgtcttcggcggagggaccaagctgaccgtccttcgtcagcccaaggctgccccctcggtcactctgttcccgccctcctctagtacgtgactgagcgggctggcaaggcgcatagnn

SEQ ID NO: 150491 - DNA, 526 bp, Homo sapiens
  misc_feature: GYAE6OF01CA5C7.13.86.H09.1.454.CMB.1.raw
  modified_base (492)..(492): a, c, t, g, unknown or other
  misc_feature (492)..(492): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactcgagtggatgggatggatcgagcccttacgaaccggaaacacgagactagtggaacacgaacctccgagggcagattcaccatgacgacagacacatacacgaacacagcctacagtggaggtgaggagccgtgagatactagacgacgacggccgttagtagttagttgtgcgaggtaggtggaggtggngaggtggatagtacgaataaattacgtattaacg

SEQ ID NO: 150492 - DNA, 182 bp, Homo sapiens
  misc_feature: GYAE6OF01CKO24.13.86.H09.1.454.CMB.1.raw
  modified_base (172)..(182): a, c, t, g, unknown or other
  misc_feature (172)..(182): n is a, c, g, or t
tcagtcacgtactacacgaccggtgctcgatttagtgctatagacttgggtttgggtgtacttcggcggagggaccaagctgaccgtccttcgtcagcccaaggctgccccctggtcactctgttcccgcctcctctagtacgtgactgagcgggctggcaaggcgcatagnnnnnnnnnnn

SEQ ID NO: 150493 - DNA, 250 bp, Homo sapiens
  misc_feature: GYAE6OF01CA0KK.13.86.H09.1.454.CMB.1.raw
  modified_base (137)..(137): a, c, t, g, unknown or other
  misc_feature (137)..(137): n is a, c, g, or t
  modified_base (224)..(250): a, c, t, g, unknown or other
  misc_feature (224)..(250): n is a, c, g, or t
tcagtcacgtactacacgaccggtgctcgatttagtgctatagactttgggtttggggcaaagggacgacggtacaccgtttcgccagcctccaccaagggcccatcggtcttccccctggcaccctcctccaagancacctctggggcacagcggccctgggctgcctggtcaaggactacttcctagtacgtgactgagcgggctggcaaggcgacatagcnnnnnnnnnnnnnnnnnnnnnnnnnnn

SEQ ID NO: 150494 - DNA, 585 bp, Homo sapiens
  misc_feature: GYAE6OF01CF0JE.13.86.H09.1.454.CMB.1.raw
  modified_base (404)..(404): a, c, t, g, unknown or other
  misc_feature (404)..(404): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtggggcctcagtgaagatctcctgcaaggcttctggttacacctttagcagtctatcttatcagctgggtgcgacgacggcccctgggacgaggactcggagtggatgggatggatcgacgcccttaacgaacggaacacgagactagtacggaacacgaacctcgaggcagattcacatgacgacagacacanacaacgaacacacgcctacagtcgggaggtagaggacgaccgtagagtatagcggaaccgacgacggtcgttagttagttagttggtacggacggtaggtaagggtcgggaggtacgggacgtaagggtgggtaacgttaacgtaccggtaaattaaacgtttaccgttaacgtttaaacg

SEQ ID NO: 150495 - DNA, 529 bp, Homo sapiens
  misc_feature: GYAE6OF01D8DXW.13.86.H09.1.454.CMB.1.raw
  modified_base (412)..(412): a, c, t, g, unknown or other
  misc_feature (412)..(412): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactcgagtggagtgggatggatcagcccttacgaacggaaacacagactatggacagaactccgaggcagattcaccatgacgacagacacatacaacgaacaacagaccctanagtggaggtgaggagcctagagaatagtgacgacgacggcgtagtactttagtggtgacgagtaggtggtaggtgggcaggtggaagtagtacgaagtaaactttcgtaagttaacg

SEQ ID NO: 150496 - DNA, 509 bp, Homo sapiens
  misc_feature: GYAE6OF01CB0N0.13.86.H09.1.454.CMB.1.raw
  modified_base (503)..(503): a, c, t, g, unknown or other
  misc_feature (503)..(503): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggagtgggatggatcgagcccttagaacggaacacagactatggacagacctcgaggcagatcacatgacgacagacacatacacgaacacagacctacataggaggtagaggagccgtagagatagtgaacgacgacggaccgttgtattagtgtgcgagagtggagtggcgaggtgatacgtacgaataagttntactag

SEQ ID NO: 150497 - DNA, 610 bp, Homo sapiens
  misc_feature: GYAE6OF01C9RER.13.86.H09.1.454.CMB.1.raw
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
  modified_base (494)..(494): a, c, t, g, unknown or other
  misc_feature (494)..(494): n is a, c, g, or t
tcagtcacgtactacacgaccggtgctcgatttagtgctatagacttgggtttgggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagaagccgtggggcctnagtgaagatctctgcgaaggtcttctggttacactttagcagtctatcttatcagcgtggtcncgacgacggcccgtggaacgagacgtcggaggttggagtgggatagggactcgacgtaccctaaagaaaccggaaacacgaacgtaactaagtacggaacaacggtaaccctccggaggacaagtacttaccactaacgtgaaccgtacaacgacaacgaactaacaacgaacacgactacctaagagtaggagtagaggacgcgtaggaantacgtagaaccgtacgaccggtacttagttagttagtgtacgacggtaaggtggtaggaaggtggacgtaggtagttaagttacgaacgttaataaaactttccgtaaagttaacg

SEQ ID NO: 150498 - DNA, 193 bp, Homo sapiens
  misc_feature: GYAE6OF01EVFEI.13.86.H09.1.454.CMB.1.raw
  modified_base (175)..(193): a, c, t, g, unknown or other
  misc_feature (175)..(193): n is a, c, g, or t
tcagtcacgtactacacgaccggtgctcgatttagtgctatagacttgggtttggggtgtcttcgggcggagggaccaagctgaccgtccttcgtcagcccaaggctgccccctcggtcactctgttcccgccctcctctagtacgtgactgagcgggctggcaaggcgcatagnnnnnnnnnnnnnnnnnnn

SEQ ID NO: 150499 - DNA, 577 bp, Homo sapiens
  misc_feature: GYAE6OF01DNB4T.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctcgtggttacattttcgactaacttttggcattctactgggtgcgacgaggcccctggccacggccttgagtcgcgtggggtgatcagttgttacaacggtgacacagtactttgctacagaagtttgaggcagagtcacctgaaccacagacacagtcccgagaacacagacctacaagtggaacgtgaggaactactgacgatctagacgacgacggaccatatattacgtagtgtacgacgtaagggttacgggttttgggcgtcggtactccgtcgttgtagtagtcggtcggggaccgaggggacgtagtcggtaccgtacgtcgtcgtacg

SEQ ID NO: 150500 - DNA, 717 bp, Homo sapiens
  misc_feature: GYAE6OF01C08OP.13.86.H09.1.454.CMB.1.raw
  modified_base (228)..(228): a, c, t, g, unknown or other
  misc_feature (228)..(228): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtcgcccactcccaggttcagctggtgcagtctgcagctgaggtgaagagccgtggggcctgagtgaagntctcgtgacgaggtcttcgtgttacctacgtttagcagtcttatacttatcgagtcgtgggtacgcgaccgacggcccgtaggacggacggacgtcggaggtggaggtacgggatggtactaccgacgtaccctaaacgaaaccggaaactacgaagtaacgtaagtacggaactaacggaacccacggtaggacagtacttaccaacgtagacggaccacgaacaactaacctaacgtaaaccgaacccgaaactaacgaaccggtaccctaaggtacggtaaggggaacggtagggaacggtccgtacggtaaggaaacggttcgtaacgtacccgggaaacggtcccgtaacgggtacgtttaggtttaacctttagggtccgtaggacgggtagggtacggtacgggttaggacgggcgttaaagggcgttaaacgttacggtaaccgtaaaaggtttaaacttttaacggaaacttttaaacgg

SEQ ID NO: 150501 - DNA, 592 bp, Homo sapiens
  misc_feature: GYAE6OF01AU19B.13.86.H09.1.454.CMB.1.raw
tcagtcacgtactacacgaccggtgctcgatttagtgctatagacttgggtttgggggacccaaaaaccacacccctccttgggagaatcccctagatcacagctcctcaccatggactggacctggagcatccttttcttggtggcagcagcaacaggtgcccactcccaggtccagctggtgcagtctgcagctgaggtgaagaagcctggggcctcagtgaagatctcctgcaaggcttctggttacacctttagcagctatcttatcagctggtgcgacaggcccctggacgaggactcgagtggatgggatggatcgagcccttaacgaacggaacacgagactatggacacgaacctccgaggaccagacttacaccatacgacgacagacacaataccaacgaacacagacctacagtagggaggtagaggagccgtagacgagtataggacgtaacgacggtaccgtagttagttacgttaggtcggtacgaacgggtaggtcgggtaaggttcggggaccgttaagggtacgggtaagttaacgtacggtaaaccttaaacgtttaaccgtaacgtttaaacg

SEQ ID NO: 150502 - DNA, 665 bp, Homo sapiens
  misc_feature: GYAE6OF01D6OU1.13.86.H09.1.454.CMB.1.raw
  modified_base (597)..(597): a, c, t, g, unknown or other
  misc_feature (597)..(597): n is a, c, g, or t
  modified_base (642)..(642): a, c, t, g, unknown or other
  misc_feature (642)..(642): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacgaggtcgcccactcccgaggttcagcgtggtgcagtctgcagctggaggtagaagacggccgtgggacctgagtagaagtactccgttaccgtgacgtaacggttcttcgttacggttacctacgtttagcgtagtacttagttcttatacgtgtccggtggggtcacggaccgccggccggtaggacggacggtcgtacggtaggtcggaggtcgggagtacggtactaaccggtaccgtaacccgtaaaacggaaaccggaactacgtaacgtacgtacggtacgaacgaaccggtaccgacggaggtacaacgtacctacgacgtaacgcgaacgacaacgtaacacgtaacaaaccacgaacacgtaccacgtacgaggtaggagtacggacgacgctagatagtaggacgaacggtcgacgttgtagtagttgagnggacgtaggcggtggtaggaggtacgtaggtagactaacgttaanaaaccttagttacctagttaacg

SEQ ID NO: 150503 - DNA, 652 bp, Homo sapiens
  misc_feature: GYAE6OF01A3ZZ3.13.86.H09.1.454.CMB.1.raw
  modified_base (283)..(283): a, c, t, g, unknown or other
  misc_feature (283)..(283): n is a, c, g, or t
  modified_base (585)..(585): a, c, t, g, unknown or other
  misc_feature (585)..(585): n is a, c, g, or t
  modified_base (595)..(595): a, c, t, g, unknown or other
  misc_feature (595)..(595): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagcctggggcctcgagtagaagatctcctgcaaggcttctggttacacctttgcagtctatcttatcagtctgggtcncggacgacggtccccgtgggaaccgaggacgtcggagttgggacgtgggatgggactcgacgtacccgtaagaaacggaaacacaacggtactagcggaacagtaaccctcggaaggcacgtataccgaacagtcgaacgacgtaacgaccaactaacgtaacgaaacccgaaacgaaccaaccggtacctaacgaaggtacgggagtagggacggacgtaccgtagaagtctaacggtacgaccggtaccggacggtcgttaggttaattaggttgtacggtacggaggttagggtagggngggttacggnggtaaggtaggttacgtaacgtaaccggttaaattaaacgtttacgtaaacgttacg

SEQ ID NO: 150504 - DNA, 894 bp, Homo sapiens
  misc_feature: GYAE6OF01DE6L8.13.86.H09.1.454.CMB.1.raw
  modified_base (160)..(160): a, c, t, g, unknown or other
  misc_feature (160)..(160): n is a, c, g, or t
tcagtcacgtactacacgaccggtgctcgatttagtgctatagacttgggtttggggacccaaaaaccacacccctccttgggagaatcccctagatcacagcctcctcaccatggactggacctggagctattccttttctggtggcagcagcaaacgnggtcgaccctactcccgtagggttcagtcgttggtcgaccgtaggttcctggaccagtcgtaggaggtagaaacgacggccggttacgggccctagtaggtagaacgtacttcctccgtgaacgtacgggtttccttacggttacgttaccttaccgttacggactcgtacttacctttacgtttaccaggtccgttcggggttcgggtaccggaacccgtaccgggtacccccggttaccggggtaacgggacgggtaaccgttccggggttaaggttagggggtagtacggggtacggtacgggtaactaccgtaccggtaaacccgttacccgaaaaaccggaaacggtaaccgaaggttaaacgtaccggtaacggaacggaaaccgtaacccgtacccggtacgggaaccgtaagtttaccgtaaccttacggaaacgttacggaaaccggtaaccgaacggaacaaaccgtaaaccgtaccgaaaaccgtaaacgaaaccctacgggtaccgtaaacggacgggttaggggtaacggacgggtaacggacggttaccgtaaggacgttacgtaaacgacggtaaccgacggtaccgggtcgtttaacgttagttacggtttaggacggttacggtacggtaaggggtacggtggtaacgggtacgtaagggttaaggtacgtaacgttacgaaaacgtttaaactttactaaccgttaggtaaaccgg

SEQ ID NO: 150505 - DNA, 659 bp, Homo sapiens
  misc_feature: GYAE6OF01EHB4H.13.86.H09.1.454.CMB.1.raw
  modified_base (286)..(286): a, c, t, g, unknown or other
  misc_feature (286)..(286): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggtccagctggtgcagtctgcagctgaggtgaagagcctggggcctcagtgaagatctcctgcaaggtcttctggttactacctttagcagctattcttatcagctggtgcgacncggcccctggacgaggactcgaggtggagtgggagtggactcacgtcccttaacgaacggaaacacgaacgactagtcggaacaacgacctacgaggcaagacttaccgaccgtatacggaaccgtacaacggaccaacgtaactaaccgaacgaaaccaacgacgtaccctaacgagttagggacggtagggaacggtacgaccgtaggaagaagttcgtaacgaccggaaccgtaaccggtacggttagttacgtttagttaggtacggacgggtaaaggtcggttaggggtagtacggggtacgtaagggttacggtaacgttacggttaaccggaaactttaaaacgtttaacccgttaacgttaaacg

SEQ ID NO: 150506 - DNA, 765 bp, Homo sapiens
  misc_feature: GYAE6OF01ALKL0.13.86.H09.1.454.CMB.1.raw
  modified_base (180)..(180): a, c, t, g, unknown or other
  misc_feature (180)..(180): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatcctttctggtgcagcagcaacaggtgcccactcccaggttcagctggtncagtctgcagctgaggtgaagagcctggggcctcagtgaagagtctcctgcaacggcctttcgtaggttactaccgtttagcagtctatccttatcaggtcgtggggtgcgacgacggtcccctggaccggaggactcggaggttggagttggggattgggatccgtaacgaccccttaacggaaaaccggtaaaccaaccgaacggtaaccgtaagtacgggaaccaaacggtaaccccgttaccggaacggggtacctaggtaaccttaacccggtacccgtaacggttacgaaccgaaccgaagaaccgtaacgtaaccgtaaacgaaacccggaaaccaaccgaacggttaccctaacgtaacgtaggggtaacggtaggaacggtacggtacccgtagtaacggtacgtacgttacggaaccggtaccggtaaccggtaccggtttaagtacgtttaacggttggtaccggtacggtagggtacgggtagggagggttacgggtacggtaagggttacggaacggttaaccggttaacgttaaaacccgttaaacgtttaaacgttaaacctttaaacgg

SEQ ID NO: 150507 - DNA, 608 bp, Homo sapiens
  misc_feature: GYAE6OF01EXEOF.13.86.H09.1.454.CMB.1.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccaaaactcccaggttcagctggtgcagtctgcagctgaggtgaagaagccgtggggcctcagtgaagatctcctgcaagcttctggttactacttagcagctatnttancagntggtgacgacgacggcccgtggacgacggacgtcgaggtggacgtgggacgtgggactcgacgtcccttaacgaacgaaaccacaacgaactatagggaacaacgaaccctaccggaaggacaggtacttacaccgatagacgacaagaacacaatacaacgaacgacacgaccacagaggaggtcggaagtacgactgagtaacgtagtacggacaccgacgggaccttagttaacttagttggtacgaggtacggaggtacggacgggtggacggtaggttagggtaacgttaacggttcgtaaaagttaaacttaactaacttaaaacgg

SEQ ID NO: 150508 - DNA, 981 bp, Homo sapiens
  misc_feature: GYAE6OF01C55TZ.13.86.H09.1.454.CMB.1.raw
  modified_base (161)..(161): a, c, t, g, unknown or other
  misc_feature (161)..(161): n is a, c, g, or t
  modified_base (737)..(737): a, c, t, g, unknown or other
  misc_feature (737)..(737): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttctggtggcagcagcaacaggtcncccactcccaggttcagctggtgcagtctgcagctaggagggtagaaacgacgccggttcggggcctacgaaggttacggtaacggttttccctggacgtaacgggtcgttcgtaggtaactaccgtaccgttactacgttaacttgtcgtacttaagtaggtaacgggtttggggtaccgaccggtaacggtacggtcccgttaccgggtaacggggtaaacggtaaacggggtttcgttaaggggacgggttagggtacggttaggggtaacggttaggtaccggtaacaacgtaactaacccgaaaaccggtaccgggtaaacccgggaaaacccttaaacggtacggtacccgggaccccggtaaggggtttaacccctaacgtaaacgggttacggggggtttaacccggtttttccgttaccccggtttaacggtttccccgttacggggtaaccccttaccgttaccgttaccgggtacgtacccggtaccggacgggttacggtttaaccgtacggtaactacgtacgtaccgtaacgggaacgttaacccgtaacggtttaaacggnggttaaccggaaccggtacgtaccgtttacccgtaaaccgtttagttttaacggtaccgttttaaggggtacgtaacgggtacgttttaaccgttttaccccggtttttaagttaacccccgggttttattaacgggttttaacccccgtttaccgttttcccggtttaccgtttaacccgttacggttacccgggttaacccgggggtaccgggtaacccgggttaacccgggttaacccggg

SEQ ID NO: 150509 - DNA, 194 bp, Homo sapiens
  misc_feature: GYAE6OF01C4ZRE.13.86.H09.1.454.CMB.1.raw
  modified_base (170)..(170): a, c, t, g, unknown or other
  misc_feature (170)..(170): n is a, c, g, or t
  modified_base (176)..(194): a, c, t, g, unknown or other
  misc_feature (176)..(194): n is a, c, g, or t
tcagtcacgtactacacgaccggtgctcgatttagtgctatagacttgggtttgggtgtcttcggcggagggaccaagctgaccgtccttcgtcagcccaaggctgcccccctggtcactctgttccccaccctcctctagtacgtgactgagcgggctggccaagggcncatagnnnnnnnnnnnnnnnnnnn

SEQ ID NO: 150510 - DNA, 619 bp, Homo sapiens
  misc_feature: GYAE6OF01DK352.13.86.H09.1.454.CMB.1.raw
  modified_base (358)..(358): a, c, t, g, unknown or other
  misc_feature (358)..(358): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacaccttttagctagctatcttatcagtctgggtgccgacacggccccgtggacgaggactcgagtggatggatggatcacgtccttaacgaacggaactacgagactagnggaacagaacctccgaggcagactacacgatcgacacagacaacgataaccacgaacaacgaagtccctacgacgtagggacgtaggacgtaaggcccttaggaacgaagtttacgacgaaaccgtacggaccgggtaccttagggtttaccttagttcggtacggtcggtaaggtagggtgggaacggttggggaccgtaaggttaggtaacgttacgtaaccggtaaccttaaaacgtttaaccgtaacttttaaacgg

SEQ ID NO: 150511 - DNA, 813 bp, Homo sapiens
  misc_feature: GYAE6OF01AP8Q7.13.86.H09.1.454.CMB.1.raw
tcagtcacgtactacacgaccggtgctcgatttagtgctatagacttggggtttggggacccaaaaaaccacacccctccttgggagaatcccctagatcacagctcctcaccatggactggacctggagcattccttttcttggtggcagcagcaacaggtgcccactcccaggttcagctgggtgcagtctgcagcgtggaggtagaacggaacgcggtcgggggtcctcgaggtagaaggtactccttaccgcgacgaacggttctttcggtacggtttaacccttacgttttacgacagtaccgttacttacgttaactcgacggttcgggttaggggtacggaccggtaaccggaccggggtacccccgtaccggggaaccgggtaacggacccggttacgggaacgggtttagggaagggtcgggggttaacgtaggggtaactacccggtaaaccgttaaccccgttaaaaccgggaaaacccgaaaacgtaccggaacgtaacgttaacgacggaccgaaccgaccgtacggacgtacgtacgtacgtaaccacgtacgcgaacgacgaacgacgaacacgtaaccgacgaactaccgacgtacacggtaaggtacggtagggtaggtacggacgtaccgtaagtacgtaacgtacggtaaccggtaccggaacggtaccggtacggtttaagttaccggtttagtacgtacgggtaaggtaggtagggtagggacgggttaggtgtaggggttacttaacgggtaccgtaagtaaaccgttaacgttaagtttaaccgttaagg

SEQ ID NO: 150512 - DNA, 826 bp, Homo sapiens
  misc_feature: GYAE6OF01C4CAU.13.86.H09.1.454.CMB.1.raw
  modified_base (128)..(128): a, c, t, g, unknown or other
  misc_feature (128)..(128): n is a, c, g, or t
  modified_base (190)..(190): a, c, t, g, unknown or other
  misc_feature (190)..(190): n is a, c, g, or t
tcagtcacgtactacacgaccggtgctcgatttagtgctatagacttgggtttggggacccaaaaaccacacccctccttgggagaatcccctagatcacagctcctcaccatggactggacctggancacttccttttcgttggtggcagcagacaacaggtcgcccacctcccgaggttcagctggtncagtctgcgagcgtaggacggtagaaaggacggccggtacggggcctcgaaggtagaagtactccgtacgcgacgtaacggttcgtttacgttacggttaactaccgtttagacgtacgtacttacttacgttacgtacgtcggtcggtacgggtacgaccggaaccgcccgggtacccggtagggaacgggaccgtcggtacgggtaggtaggtaggtacgggtaggacggtacgtccgaaccgtaacccgtaacgaaaccgaaacacgtaacggtacgttacgaaacggaccgaaccggtaaccgacgggacggtaacgtacttaccgaacccgtagtaacggaccgaacgtaaccgaaccgaaccaaccgttaaaccgaaccgtaaacccgaacctacgaaccgtaaccgtagtaccgggtagggtacgacgggtaagtaccggtacgtaaggagttaagtaaccggaggtaaccggaacgtaccgggttactttaagggtttacgttaaggttcgggaaaggttacgggtagggttacgggtaaggggaacggtttaacgggaggttaagggttaacgtaacgttaacggggtaaaccttaaaggttaaaccttaagtttaacgtaaacggg

SEQ ID NO: 150513 - DNA, 748 bp, Homo sapiens
  misc_feature: GYAE6OF01B2A3G.13.86.H09.1.454.CMB.1.raw
  modified_base (590)..(590): a, c, t, g, unknown or other
  misc_feature (590)..(590): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttctggtggcagcagcaacaggtcgcccactcccgaggttcagcgtggtgcagtctgcagctggaggtagaagacgccgtggggcctcgaggtgaagtactcgtacgtgacgaaggtcctttcgtacggtacctacgtttacgcgtagtctacgttcttatcaggtcgtggggtcgacgacgaccggccgtaggacgaggtacctcggaggtggaagtgggtacgtggactaccgacggtacccgtaaacggaaacggaactacgaagtactaggtacggaacgtaacgtacccgtacggaacggactaacgtacgtaaccaacgtacgtacggaaccgacgtaaacgaaccgtaaccgaaacgtaaaccctaaacggaaaccctaacggtaaccctacccgttaaggacggggttacggggaaacggtacgggaacggaccgtaccggggtaanaagggttaaaccttcggaaccgggtaaccgacgggttaacccgggttcgttaagtttagtttaccggttaggtacgggaacggttacggtagggtaccgtagggtcggaagtacggttagtacgtaacgtacgaaattaacgttactagttaaaccgg

SEQ ID NO: 150514 - DNA, 635 bp, Homo sapiens
  misc_feature: GYAE6OF01BW24F.13.86.H09.1.454.CMB.1.raw
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (581)..(581): a, c, t, g, unknown or other
  misc_feature (581)..(581): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (611)..(611): a, c, t, g, unknown or other
  misc_feature (611)..(611): n is a, c, g, or t
  modified_base (619)..(619): a, c, t, g, unknown or other
  misc_feature (619)..(619): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtcacgtactacacgaccggtgctcgatttagtgctatagacttgggtttgggatggatcagcccttacaacggaaacacagactatggacagaacctccagggcagattcaccatgacgacagacacatacacgaacacagcctacagtggaggtgaggagcctgagatatgacgacacggccgtgtattatgtgcgagagtggagtggcgagtggatatacgaactaaattactacttattacagtcggacgtcgtaggggacgaaacgggtacgacggtacctaccggttcgaccgacgtcctaccgaccgacggccctacgtccggtcccgttccccgtgccctaccccgtaccctaccgaagacgacctaccgtcggtcggggccgacgaccggtccggccccggtagggcccgtcggcccgttaggtaccgtaaacgggtacccgtttaacttcccggtaacggttacgttacggaccggtttacgggacgggtccggggtacgttaggggacccgaaacggggttccgaccgtaaggtaccgntacgngtccanacgtctgatccgagtcncgacgncgagtcgngngngngngngctcgncgtcgacncgcgcagcgngngtcg

SEQ ID NO: 150515 - DNA, 802 bp, Homo sapiens
  misc_feature: GYAE6OF01DM1O1.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcattccttttctggtggcagcggcaacaggtcgtccaccctgaggttcagtttggttcagtcgtgggagggaggggtgaagaagccgtggggcctcgaggtgcgaggtcgccgtgcgacgggccttcgttggttacttagtttccgactaacgtttgctattcgtacgtggggtcgaccgaccgtaccggccccgtcgggacccgtaccgggtccgttttacgggacggtccggtcgggttcggggggtaggtacgttacggttaggttttacggtaaccgtaacgggtagaacccgtaacgtacgttaccgtttgacctaacggtaaggttaagttcgggacggtacgaggtacgttacccacccgtacggacccaacgacgaacctacacggtcccgaacgaaaccaccgtacgtaccctaagtacgtaaggaacgtaggtacggtaatcgtacgtaacgtacgtacgtacgaaccggaaccgtacggaccttaagtttaacttcttaccggtacggtacggtaacgggaagggtttaaaccggggtttttcgggggtttggggacccggttacggtacccgttccgttaggtcggtaacgtacgggttacggggcgggaaaccgggtagggaaacttaggttacggaccctacccgtcgttccggtacccg

SEQ ID NO: 150516 - DNA, 911 bp, Homo sapiens
  misc_feature: GYAE6OF01DIXAJ.13.86.H09.1.454.CMB.1.raw
  modified_base (131)..(131): a, c, t, g, unknown or other
  misc_feature (131)..(131): n is a, c, g, or t
  modified_base (143)..(143): a, c, t, g, unknown or other
  misc_feature (143)..(143): n is a, c, g, or t
  modified_base (166)..(166): a, c, t, g, unknown or other
  misc_feature (166)..(166): n is a, c, g, or t
tcagtcacgtactacacgaccggtgctcgatttagtgctatagactttgggtttggggaacccaaaaaccacacccctccttgggagaatcccctagatcacagctcctcaccagtggactggacctgganctattccttttnttggtggcagcagcaacaggtcncccactccgtaggttcagcgttaggtgacgtagtctgacaggcgtaggtaggagaaagtacggtccggtcggggcccttacgaaggttacggaaacgttcttaccgtccggttacggtacgtaacgggttccttttacggttaccggtttaaccctaccgtttaacgcgtaacgttaccttaacgtttcccgttaagtccgtacgggttccggttaggggttacccggaccgtaaccccggggtaccggttacccccgggtaaggggtaccgggtaaccgggtaaccggtcggggttaagggtaaggggtacgggtagggtagttcggtaaccgttaccggtaaaccgtaaccccgtaaaggaaaacccgtaagtaacggaacgtaaccgttaacggaaccgtaacgaaacccgggtacgtaaccggcgggtaaactacggttaaccctacgtaacgtacggtaacgtaaccggaacaacgaaacctaacgtaaacaaccgaaccctaaacgaccgtaacccgtaacctaaggtaacgggttacgggtaggtaacggacggtaacgccggttaagtaccgtaagttaaccggaaccggaacggttaaccgggtaccggtaagtttacgtttagtttacggttacgggtacggtaaggtaggacggggttggaacgggttacggtagtaacggttagaaacgtttacgtaaaacgttacttaaaaccgtggtttaaactaaacggg

SEQ ID NO: 150517 - DNA, 765 bp, Homo sapiens
  misc_feature: GYAE6OF01E0JV8.13.86.H09.1.454.CMB.1.raw
  modified_base (581)..(581): a, c, t, g, unknown or other
  misc_feature (581)..(581): n is a, c, g, or t
  modified_base (610)..(610): a, c, t, g, unknown or other
  misc_feature (610)..(610): n is a, c, g, or t
  modified_base (678)..(678): a, c, t, g, unknown or other
  misc_feature (678)..(678): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtaggcagcagcaacgaggtcgcccactcccaggttcagctggtgacagtctgcagctgacggtagaagaacgccgtggggacctagacgttagaacgatccgtccgtagaccgtaaggtcctttcggtacggttacctaccgtttagaccgtacgtacttaacttacgttacgtcgaacggttcggtcggggtcgaccggtacggtacccgggaccccggttaggggaacccgtaacggggtaccgttacgggtagggtacggtaagggtacggggtagtacgggtaactaccggaaccggttaaccctaaccggaaaaccggtaaaccaacgtacgtacgtaaacggtacgtaaccgaacgtaacccgcggaacggcaacgtctacgacgtagtacgaacgaacgacgtaaccaactacggtaacaaaccggaaacnccaacgaccttacggaaggcggtaagggngaccggtaacgcgtagacgagtaacgacggaaccgtacggtagttaccgtaagttacttagggtacgngggtacgtaccgggaggttacggcggtagtaggacggtagtaacgttaaccgaacggttaaactaacgttacgttaaccgttaacgg

SEQ ID NO: 150518 - DNA, 606 bp, Homo sapiens
  misc_feature: GYAE6OF01BA7HF.13.86.H09.1.454.CMB.1.raw
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (499)..(499): a, c, t, g, unknown or other
  misc_feature (499)..(499): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctacagtgaagatctcctgacaaggtcttctggttacaccttagctagctatcttancgagctgggtcncgacncggcccctggacgacgacgtcggagtggagtggatggatcgacgtcccgtaacgaacggaaccacgaagtacgtaagacgggaacaaggaccctcggacgggcaacgtacttccaactagtacgaccaacgagaccaacacttaacccaacgaaccgaacgtacgaccttaaccggaggtacggaggtaggaggtacggctagaacgtanaggtcgaacgacgtaccggtacgtgttaagttgtcggagacgtaggacggtggtaacggtggcgtaggtagtaagtacttacggaaataatttaccgtaagttaacg

SEQ ID NO: 150519 - DNA, 630 bp, Homo sapiens
  misc_feature: GYAE6OF01EBNCE.13.86.H09.1.454.CMB.1.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaacgccgtggggcctcgagtgaagatctcctgcaaggtcttcgtggttactaccttagctagctatcttancagngtggtnccgtacgacggccccgtagggacgtacggactacggaggtggagtgggatggactcgacgtaccctaagaacgtaaccanagtactagtacggaacaacggtaacctaccggacggacagtacttaccgaacacggtacgaacgacgaacacctaacaactaacgaaccaacgtaaccgacgtacccgttaacgaggttagggacggtaggtaccggacgtaccgtagacgtaagtagtaccggacgtaccgacggtacgttagttattacggttgtaggacggagtacgggtggaggttggacgtaggttgactacgtaacaagttaaacttagtcttaaacgg

SEQ ID NO: 150520 - DNA, 176 bp, Homo sapiens
  misc_feature: GYAE6OF02F37F7.13.86.H09.1.454.CMB.1.raw
  modified_base (172)..(176): a, c, t, g, unknown or other
  misc_feature (172)..(176): n is a, c, g, or t
tcagtcacgtactacacgaccggtgctcgatttagtgctatagacttgggtttgggtgtcttcggcggagggaccaagctgaccgtccttcgtcagcccaaggctgcccctcggtcactctgttcccgccctcctctagtacgtgactgagcgggctggcaaggcgcatagnnnnn

SEQ ID NO: 150521 - DNA, 187 bp, Homo sapiens
  misc_feature: GYAE6OF02ICKAU.13.86.H09.1.454.CMB.1.raw
  modified_base (173)..(187): a, c, t, g, unknown or other
  misc_feature (173)..(187): n is a, c, g, or t
tcagtcacgtactacacgaccggtgctcgatttagtgctatagacttgggtttggggaagaggaaggactgacggtccccaggagttcaggtgctgggcacagcggccctgggctgcctggtcaaggactacttccgtagtacgtgactgagcgggctggcaaggcgcatagnnnnnnnnnnnnnnn

SEQ ID NO: 150522 - DNA, 173 bp, Homo sapiens
  misc_feature: GYAE6OF02GJGAN.13.86.H09.1.454.CMB.1.raw
  modified_base (172)..(173): a, c, t, g, unknown or other
  misc_feature (172)..(173): n is a, c, g, or t
tcagtcacgtactacacgaccggtgctcgatttagtgctatagacttgggtttgggtgtcttcggcggagggaccaagctgaccgtccttcgtcagcccaaggctgcccctcggtcactctgttcccaccctcctctagtacgtgactgagcgggctggcaaggcgcatagnn

SEQ ID NO: 150523 - DNA, 425 bp, Homo sapiens
  misc_feature: GYAE6OF02FJYPE.13.86.H09.1.454.CMB.1.raw
  modified_base (419)..(425): a, c, t, g, unknown or other
  misc_feature (419)..(425): n is a, c, g, or t
tcagtcacgtactacacgaccggtgctcgatttagtgctatagacttgggtttgggatggatcagcccttacaacggaaacacagactatggacagaacctccagggcagattcaccatgacgacagatacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctcaccaagggcccatcggtcttccccctggcaccctcctccaagagcacctctgggggcacagcggccctgggctgcctggtcaaggctacttcctagtacgtgactgagcgggctggcaaggcgcatagnnnnnnn

SEQ ID NO: 150524 - DNA, 174 bp, Homo sapiens
  misc_feature: GYAE6OF02G6EDG.13.86.H09.1.454.CMB.1.raw
  modified_base (173)..(174): a, c, t, g, unknown or other
  misc_feature (173)..(174): n is a, c, g, or t
tcagtcacgtactacacgaccggtgctcgatttagtgctatagacttgggtttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 150525 - DNA, 178 bp, Homo sapiens
  misc_feature: GYAE6OF02FT5UK.13.86.H09.1.454.CMB.1.raw
  modified_base (173)..(178): a, c, t, g, unknown or other
  misc_feature (173)..(178): n is a, c, g, or t
tcagtcacgtactacacgaccggtgctcgatttagtgctatagacttgggtttgggtgtcttcggcggagggaccaagctgaccgtccttcgtcagcccaaggctgccccctcggtcactctgttcccgccctcctctagtacgtgactgagcgggctggcaaggcgcatagnnnnnn

SEQ ID NO: 150526 - DNA, 506 bp, Homo sapiens
  misc_feature: GYAE6OF02IS2RF.13.86.H09.1.454.CMB.1.raw
  modified_base (491)..(491): a, c, t, g, unknown or other
  misc_feature (491)..(491): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcggagtggatggggatggatcagcccttacaacggaaacacagactatggacagaacctcaggcagattcaccatgacgacagacacatacacgaacacagcctacataggaggtgaggagcctgagatagtgacgacacggcgtgtattagtgtgcgagagtggagtggcaggtggatagtacgtaanaaagttactataacg

SEQ ID NO: 150527 - DNA, 537 bp, Homo sapiens
  misc_feature: GYAE6OF02IMDZH.13.86.H09.1.454.CMB.1.raw
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcatggggcctcagtgaagatctcctgcaaggcttctggttacacctttagcagctatcttatcagcgtgggtgcgacacggcccctggaccgaggactcggagtggagtgggatggatcgacgcccttaagaacggaaacacagactanggacaagacctcgaggcagatcacatcgacganagacacatacaacgaacacagacctanagtaggagtgaggagctgagatagagaacgacgacggtccgtagttaagtttagtggtgacggaggtaggtggaggtggacgtaaggtggtaagttacgtacggaacttaattacgtaacg

SEQ ID NO: 150528 - DNA, 512 bp, Homo sapiens
  misc_feature: GYAE6OF02HD1O3.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctcagggcagattcaccatgacgacagacacatacacgaacacagccacagtggaggtgaggagcctagagatagtgaacgacgacggccgtgtattagttgtgcgagagtgggagtggcgaggtggatagtacgaactaaattacgtattaacg

SEQ ID NO: 150529 - DNA, 521 bp, Homo sapiens
  misc_feature: GYAE6OF02FKBSR.13.86.H09.1.454.CMB.1.raw
  modified_base (427)..(427): a, c, t, g, unknown or other
  misc_feature (427)..(427): n is a, c, g, or t
tcagtcacgtactacacgaccggtgctcgatttagtgctatagacttgggtttgggggacccgaaaaaccacacccctccttgggagaatcccctagatcacagctcctcaccatggactggacctggagcatccttttcttggtggcagcagcaacaggtgcccactccctaggttcagctggtgcagtctgcagctgaggtgaagaagcctggggcctcgagtgaagatctcctggcaaggcttctggttacacctttagcagctatcttatcagctgggtgcgacaggcccctggacgaggactcgagtggatggggatgggatcgagcccttaacaacggaaacacagactatggacagaacctcagggcagattcaccatgacgacagacacatacacgaacacagccacatggagtgaggncctgagactatgacgaacacggccgtagtacttattgtgcgagtagtggagtggacgtagtacggatagtacggaacaaacttactacttaacg

SEQ ID NO: 150530 - DNA, 179 bp, Homo sapiens
  misc_feature: GYAE6OF02IBCTR.13.86.H09.1.454.CMB.1.raw
  modified_base (173)..(179): a, c, t, g, unknown or other
  misc_feature (173)..(179): n is a, c, g, or t
tcagtcacgtactacacgaccggtgctcgatttagtgctatagacttgggtttgggtgtcgttcggcggagggaccaagctgaccgtccttcgtcagcccaaggctgccccctggtcactctgttcccgccctcctctagtacgtgactgagcgggctggcaaggcgcatagnnnnnnn

SEQ ID NO: 150531 - DNA, 550 bp, Homo sapiens
  misc_feature: GYAE6OF02I716R.13.86.H09.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
  modified_base (401)..(401): a, c, t, g, unknown or other
  misc_feature (401)..(401): n is a, c, g, or t
tcagtcacgtactacacgaccggtgctcgatttagtgctatagacttgggtttggggacccgaaaaaccaacacccctcccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatcncctgcaaggcttctggttacacctttagcagctatcttatcagctgggtncgacaggcccctgggacgaggactcggagtcggatgggatggatcagcccttaacgaacggaaacacgagactagtggacacgaacctcgagggcaagacttcacatgacgacagacanactacacgaacacagaccctacagtacggaggtagaggacgccgaggagaatagtagaccgagaccggacgttgtaattagttgtagcgtaagaggtgggaagtggcgtagtgggaattagtaccgaagtaaacttacgtaacttaacg

SEQ ID NO: 150532 - DNA, 588 bp, Homo sapiens
  misc_feature: GYAE6OF02GF9P8.13.86.H09.1.454.CMB.1.raw
  modified_base (280)..(280): a, c, t, g, unknown or other
  misc_feature (280)..(280): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagcgtgggtncgacacggcccctggacgaggactcgagtggagtgggatggatcgacgtccccttaacgaacggaaacacgagactagtaggaaccaagaaccctccgaagggacaagacttaccgacctagtacgacgacacgtacaacataacaacgaacacacgacctacagtaggaggtagagggacgccgtaggacgagtacgtaggaacgacgaccgggtccgtagttattagttgtcggtacgaggtaggtgggtaggtgggacgtaggttaggattacgtaccgtaactaaacgtttaccgtatttaacg

SEQ ID NO: 150533 - DNA, 433 bp, Homo sapiens
  misc_feature: GYAE6OF02IPE9L.13.86.H09.1.454.CMB.1.raw
  modified_base (159)..(159): a, c, t, g, unknown or other
  misc_feature (159)..(159): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (413)..(413): a, c, t, g, unknown or other
  misc_feature (413)..(413): n is a, c, g, or t
  modified_base (416)..(433): a, c, t, g, unknown or other
  misc_feature (416)..(433): n is a, c, g, or t
tcagtcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtnaggagcctgagatatgacgacacggccgtgtattattgtgcgagagtggagtggcagtggatatcgacaaattactactattacatggacgtctggggcaaagggacgacggtnaccgttcgccagcctccaccagggcccancgtctcccctgcnccctcctccagngcacctctggggcacngcgccctgggctcgctggtcaacggactacttcctagtacgtgacctggagcgggctgggcaaggcgcanagnnnnnnnnnnnnnnnnnn

SEQ ID NO: 150534 - DNA, 532 bp, Homo sapiens
  misc_feature: GYAE6OF02HU6LM.13.86.H09.1.454.CMB.1.raw
  modified_base (385)..(385): a, c, t, g, unknown or other
  misc_feature (385)..(385): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacacggcccctggacgaggactcgaggtggatgggatggatcagtcccttaacaacggaaacacgagactagtaggacacgaacctcgagggcaagatcaccangacgacagacaacatacacgaaacacacgccacataggacgtgaggagcctagagatagtgacgacgacggccgtagtattacgtgtgacggaggaggttaggaggtggcgtaggtggaatagtacgtaactaaattactattaacg

SEQ ID NO: 150535 - DNA, 700 bp, Homo sapiens
  misc_feature: GYAE6OF02H3O35.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagaagcctgggggcctcagtgaagatctcctgcaaggcttctggttacacctttagcagtctatcttatcagctgggtgcgacacggcccctggacgaggactcggagtggagtgggatggatcgagtccttaacgaacggaaacacagactagtaggacacgaacctcgaaggcagacttaccaaccgagtacggaaccgaacgacgtaaccaacctaaacgtaaccgaaaccgaaacaacgaacgacccgtaaactaaggtacgggtacgggttaggaacgggtacggaccgtaggaaggtaacgttaggacgtaaaccggaaccggtaacccgggtacccggtttagtttaaacgtttaacgtttagggttacggaccgggtaaagggttacgggttaagggggtaacggttaggggtaacgtaacgggttagggtaacgtttaaccgggttacgtaaacccgttaaaattttacccggttaaactttaaaccg

SEQ ID NO: 150536 - DNA, 548 bp, Homo sapiens
  misc_feature: GYAE6OF02HRA65.13.86.H09.1.454.CMB.1.raw
  modified_base (458)..(458): a, c, t, g, unknown or other
  misc_feature (458)..(458): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgaggtggatgggatggatcgagcccttaacgaacggaaaccacgaacgactagtaggacaagaacctccgaagggacaagtacttcaaccagtacgacgacacgacacatacacgaacacagacctacataggaggtagaggacgctgagagtanagacgacgacggaccgtgtattagttagtgacggagaggtggaggtaggacgaggtaggtagtagtacgaactaaacttactacttaacg

SEQ ID NO: 150537 - DNA, 643 bp, Homo sapiens
  misc_feature: GYAE6OF02JBCZG.13.86.H09.1.454.CMB.1.raw
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttaccaccgtttagcngctatcttatcagctgggtgcganacggcccctggacgaggctcgagtggatgggatgggatcgacgccttacaacggaacacagactatggacagacctcaggcagactcacngtagacgacagacanactacacgaacactacgacctaacgagtagggaggtggaacggacgtcccagggtaataacgtaatacggaacgtaaaccggaaccggggtacccgttaaggttaacgttttaaggttagggttacgggaccgggtaaggtacggggttaacggggtacgggttacgggtaaccgtaacgggttagggtaacgttttaacggtacccggaaaaccgttaaaaacgttttacccgttaaacgttttaaacccgg

SEQ ID NO: 150538 - DNA, 554 bp, Homo sapiens
  misc_feature: GYAE6OF02I5GAC.13.86.H09.1.454.CMB.1.raw
  modified_base (282)..(282): a, c, t, g, unknown or other
  misc_feature (282)..(282): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
tcagtcacgtactacacgaccggtgctcgatttagtgctatagacttgggtttgggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtncgacacggcccctggacgacggactcggagtggagtgggatggatcgagacccttaacgaacggaaacacgagactaagngaacacgaacctcgaaggcagtacttcaccatagacgacagacacactaacaacaacacacgaccaacagtaggaggtagacggacnccgtagagatanacggacgacgacggtaccgttagtacttagttgtacgacgaggtaggtggtagtaggcgtagtggatagtacgaataacgttactacttaacg

SEQ ID NO: 150539 - DNA, 527 bp, Homo sapiens
  misc_feature: GYAE6OF02GFS1B.13.86.H09.1.454.CMB.1.raw
  modified_base (331)..(331): a, c, t, g, unknown or other
  misc_feature (331)..(331): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcgagcccttanaacggaaacacagactatggacagaacctcgaggcagatcacatgacganagacacatacacgaacacgacacctaanagtagggagggtgaacgggacgcctggagaatagacgacgacgacggccgttagtacgttattgtgcgagaggtggagtggcgtaggtaggatagtacgaactaagttactagttaac

SEQ ID NO: 150540 - DNA, 565 bp, Homo sapiens
  misc_feature: GYAE6OF02HFHZ2.13.86.H09.1.454.CMB.1.raw
  modified_base (357)..(357): a, c, t, g, unknown or other
  misc_feature (357)..(357): n is a, c, g, or t
  modified_base (426)..(426): a, c, t, g, unknown or other
  misc_feature (426)..(426): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacactttagcagctatcttatcagctgggtgcgacacggcccctggacgaggactcgagtggagtgggatggatcgacgacccttacgaaacggaacacgagtactancggacagaacctcgaggcagacttacacagtcgacgacagacaacataacacgaacacgacgacctaanagtggaggtagaggacgccgtaggagatagtagaacgacgacggtcgttagttacttagttgacggagtaggagggtcgggaaggtcggacgtaggtaggaagttacgtacggtaaactaacgtttacctaagtttaac

SEQ ID NO: 150541 - DNA, 668 bp, Homo sapiens
  misc_feature: GYAE6OF02JJJ0C.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggacctcagtgaagatctcctgcaaggcttccggatacacctcaataggaaactatcgtccactatgtgcgacacggccccaggacaagggcttcgtggtggagtggggtgactccgaaaccgtaagtaggtcggtagaaccaactaaactagtaggaacgaaagtaagttggacgggccggtacaaccgtagtcgaaccgagggacacgtaccatacaactacacgtacctcgagtcggaactcgacgagacgtacgacctcgtacgaaccgtacgaccggtcgttaacgttacgttacgtcggtacgtaccggttaaccgtaaaccgtcgaacgttaacccgttaacgtttacgtttacggttaaacgggttttcgggaacccggttaagggacccggttccgttaccgggttaccgttacccgttaccgttacccgtacgtcccgttaaccccg

SEQ ID NO: 150542 - DNA, 653 bp, Homo sapiens
  misc_feature: GYAE6OF02HX94O.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagactcctcctgacaaggtcttctggttacacctttagcagctatcttatcagtctgggtgcgacgacggcccctaggacgaggactcggagtggacgtgggatggatcgacgtcccttaacgaacgaacacaagacctaagtcggaacacggtaaccaccgagggcaagtactccaacctatcgaacgaacacgaacaacaactacaacgaaaccaacgacgacccgtaacactacggggaggttacggaaggacgtaccgtaggaagtaacttaagtacgaacgaaccgaccgggtaccgttaggtttaacttacgtttagggcgtacgggtaaggtaaggggtacgggtacgggttacgggtagtaagggttacgggaagttacggtaacccggttaaaactaaaacgttttacctaatttaaacgg

SEQ ID NO: 150543 - DNA, 710 bp, Homo sapiens
  misc_feature: GYAE6OF02GYK5T.13.86.H09.1.454.CMB.1.raw
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgacaaggcttctggttacacctttagcagtctatcttatcagtcgtgggtgcgtacgacggtccccgtggaccgaggtcctcggaggtggagtgggagtggactcacgtcccgttaacgaaaccggtaaacacgaagtaactagtacggaacaacgtaacccgtccggaacgggacctaacgtacctttacgaaacccgaacgttacggaaccgaaccgaaacggaaccaaaccgtaaactaaccgaaacccgtaaaaccgaaccgaaccggtaaccctaacgaacggtacgggtaacgggttacggaacgggacgtaccggtaggaacgtacgtaacgcgggaaaccgaccggtaaccggtccgttaaggttagtttaacgttgggtacgtacggaacgggtagggtacgggagggtcggacggttaggtacgggtaatacggtaccgtaagtaaactttacgtaactttaacgg

SEQ ID NO: 150544 - DNA, 572 bp, Homo sapiens
  misc_feature: GYAE6OF02I0TVD.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaaggtttcctgcaaggcgtctggatacacgttcactacttatgctatgaagttgggtgcgacaggctcctggacaagggcttgaggtggagtgggatggatcgacatcaacacgtaggaacccaacgtatcgacccagggtcttacgacgtaggtacggtttgtccttctccgttggactacctctgtcagcgacggcgtatgtacagatcagcacgacctaaaggctagacgacacgtgacctatttatacttgtgtagagtagtatttccgttttccgttagtaaccgttaccggttacttcgttcgttccttacggaccttacggtcggggtccgagggtaaccccg

SEQ ID NO: 150545 - DNA, 617 bp, Homo sapiens
  misc_feature: GYAE6OF02IZG98.13.86.H09.1.454.CMB.1.raw
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcgagtgaagatctcctgcaaggcttctggttaactacctttagcagcttatcttatcagtcgtggtgacgacgacggccccgtaggacgaggtacgtcggaggtcggagtggggatacgggatacgacgtacccgttaacgaaacggaaacacgaacggactagtacggaacacgaacccgtccgaggacagtactacaacancgacacganactacatacacgaacacacgaccacgagtgacggtagaggtcgacgagaagtagtacgtacgacgaacgacggtaccgttagtatttagtacgtaggacggtaagtacggtgggtaacggtggacgtaaggttaggttagtacggttaaccggtaaacttaaacgtttacccgttaatttaaccgg

SEQ ID NO: 150546 - DNA, 583 bp, Homo sapiens
  misc_feature: GYAE6OF02ICX9X.13.86.H09.1.454.CMB.1.raw
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttcgtggttacacctttagcagctatcttatcagcgtgggtgcgacacggcccctggacgaggactcgagtggagtgggatggatccgacgtacccttaacgaacggaaacacgagaactagtggaacacgaaccctcgaggcagtacgtacaccgatacgacgacgacgaccaacactaacacgaacacacgacctaacagtcggaggtagacggacgaccgtagagtaatagtacggaacgaaccgacgggtaccgttagtagtttacgttgtagacggtaaggtagggtaggtacggtggacgtaggtaggatacgtagaactaaattacgtactaacg

SEQ ID NO: 150547 - DNA, 622 bp, Homo sapiens
  misc_feature: GYAE6OF02I7QQL.13.86.H09.1.454.CMB.1.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctcagtgaagntctcctgcaagcttcgtggttacactttgcagtctatcttancagcgtggtgcgacacggcccctggacgaggctcggagtggagtgggatggatccgacgtacccttaagaacgaaacncaagactagtcggacaacgtaccctacgacgggactaagacttccgaactagtcgaacgtacaagaccaacataaccaacgtaaacacacgaccctaagacgttaggacggtaggaacggtccgaccgtaggacgtagtacgtcggaaccgtagaccgggttacgtaagtactttaggtacgtacggacgtaaggacggttgggtaacgttcgggaacgttaggtagggtacttaacgtaccggaaacttaaacgtttacccgtaaagtttaacgg

SEQ ID NO: 150548 - DNA, 558 bp, Homo sapiens
  misc_feature: GYAE6OF02GLEPE.13.86.H09.1.454.CMB.1.raw
  modified_base (279)..(279): a, c, t, g, unknown or other
  misc_feature (279)..(279): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatcgtcctgcaaggcttctggttacactttagcagctatcttatcagctgggtncgacaggcccctggacgaggactcgagtggatggatggatcagcccttacgaacggaaacacgagactatagggacaagaaccctccgagggcaggaattccactanagacgacagacacatacacgaacacagccanatgagtagagagcctgaganagtgaacgacgacggtacgtagtagttacttagngtacgagaggttagggacggttacggtacgaaggttacggaagttacgtaccggtaaacgtaaacttttaaccgtacgtttaaaacg

SEQ ID NO: 150549 - DNA, 884 bp, Homo sapiens
  misc_feature: GYAE6OF02IISKE.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactaggacctggagcattccttttcttggtggcagcagcaacaggtgcccactcccaggttcagctggtgcagtctgcagctgaggtagaagaagccgtaggggccttacgaggttgaaacgtacttaccgtccgttacggacgtaaacggggtccttttaccgttacgggtttaacctaccccgtttttaagacccgtaacgtaccttaacgttaccgtttaactccgtaaggcccttgggggtacgaccggtaacgacggtcccccggtaggaccgtaagggtaccttacgggaggtgggacgtaacgggtcgtagggtactacggtaaccgtacccgttaaaacgaacgggaaaacaacggtacgtaaccgttaagacggggtaacccaaccgtaaaccgtacccggaaggggttccaaacggaactttacccgaaacccgaagtttaaccgggtaacccgaaacggaacggttaacccaaaacgtaaccgttaaaacgaacccggaaaacttaaccgacgggtaccccttaaagagggttaccggggaaaggttcgggaacgggtacgtaccggttaacggaagtaacggtttaacgtaaggtacccgaaccgttaacccgggccggttttaaggttaacctttaggtttacgacggtaccgggtaaggtaacgtttcggggaacggtttcggaaccggttcggtaaggttaccgtaaaggttaccaaaaccggttaaaccgttttaaccggtaatttaaaccgg

SEQ ID NO: 150550 - DNA, 535 bp, Homo sapiens
  misc_feature: GYAE6OF02FJTY5.13.86.H09.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (419)..(419): a, c, t, g, unknown or other
  misc_feature (419)..(419): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttaccacctttagcagctatcttatcagtctgggtgcgacacggcccctggacgaggactcggagtggatgggatggatcagccttaagaacggaacncagactancggacagaaccctcgagggcagtacttccacatcgacacagacacaataccacgaaacacagaccanagtggagtagacggacgacctagagtatagacgacgacgacggtccgtatattgttgtcgagagaggtggagtcggacgaggtcgatacgtacgaactaacgttactacgttaacg

SEQ ID NO: 150551 - DNA, 665 bp, Homo sapiens
  misc_feature: GYAE6OF02FOPDZ.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgacaaggcttctggttacacctttagcagctatcttatcagcgtggtgcgacgacggtccccgtggacgaggactcggagtacggagtagggatggatcgacgtacctaacgaacgaaacacgagtactagtgaacacgaacctcgaggcaaggtcttaccgacagtacgacgacgaacgtacgaacaacgtaaccgaaacggaaaccaaccgaacgtaaccctacaaggttacgggacggtagggtacgggacgtccgtaagaacgtacgtagtaggaaccgtaacggtccgggtaccgttaagttaaccgtttacgttagtacggtacgggagtaacgggtagggtaacggtgggtaccgtaagggttacgggttaacgttacggtaacccggtaaacgttaaaacgtttaaccgtaagttttaaaccgg

SEQ ID NO: 150552 - DNA, 522 bp, Homo sapiens
  misc_feature: GYAE6OF02GN9HC.13.86.H09.1.454.CMB.1.raw
  modified_base (498)..(499): a, c, t, g, unknown or other
  misc_feature (498)..(499): n is a, c, g, or t
  modified_base (501)..(522): a, c, t, g, unknown or other
  misc_feature (501)..(522): n is a, c, g, or t
tcagtcacgtactacacgaccggtgctcgatttagtgctatagacttgggtttgggtccgccaggctccagggagggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccacggtcaccgtctcctcacgcctccaccgaacgggcccagtccggtccttcccccgtcggccgccctcgcctccgaggcgccacctccgagagcacacggccggcccgtcgggcctcgccgtgggtaccaacgggtaccttacgtttacccgtaggtacggtcgacgttggacggtcggggctgggaccgaagggcgacgagtaggnngnnnnnnnnnnnnnnnnnnnnnn

SEQ ID NO: 150553 - DNA, 796 bp, Homo sapiens
  misc_feature: GYAE6OF02HYLST.13.86.H09.1.454.CMB.1.raw
  modified_base (279)..(279): a, c, t, g, unknown or other
  misc_feature (279)..(279): n is a, c, g, or t
tcagtcacgtactacacgaccggtgctcgattttagtgctatagacttgggtttggggacccaaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagagcctggggcctcagtgaagactctcctgacaacggtcttcgtggttactacctttgctagtctattcttancagcgtggtgcgacgtcggcccctggaccgtaggacgtggagtggatgggattacgggcttaccgacgtacccgttaacgaaaccggtaaacaccgtaacgtaacgtaacgacggtaaacgacgtaaaccccgtcggaacgggactaacgtacttaacccgacgtaacgtcgaaacgaacgtaccgaaacctaacgtaactaaccaaccggtaaaaccacgaaaccggtacctaaacgacggttaaggggaacggtagggtaaaccgggactacccggtaagacgtaacgtttaaggtaacccggaccggtaaacccggacggggttaaacccgtttaggttttaaacgttttaaccgggtttacgggtaccgggtaacggtttacgggggtacgggttaacggggtaaccgggggtttacggtaacccggggttagggtaacggtttaaaccggtttacttaaacccgggtttaaaacgtaaacctttttaacccgggtaactttttaaaacccgg

SEQ ID NO: 150554 - DNA, 824 bp, Homo sapiens
  misc_feature: GYAE6OF02JCHYW.13.86.H09.1.454.CMB.1.raw
  modified_base (158)..(158): a, c, t, g, unknown or other
  misc_feature (158)..(158): n is a, c, g, or t
  modified_base (732)..(732): a, c, t, g, unknown or other
  misc_feature (732)..(732): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccttttcgtggtggcagcagcaacgnggtcgcccactcccgaggttccagcgtggtgcagtctgcagtcgtagaggtgaaaggacgtccgtcgggaccttcgaaggttggaaacgtcttccgtacgtcgtacgaacgggtctttacggtcgtttaacctaacccgttttagccgttagtcctttagttacctttagcctacggtcggttcgggtcgaccgtaaccggtaccgggtccccgttaaggggacggacggtaccgtacgggtacggtacgggtacggtggggtaacgttcgggtaacctaccggtaccggtacccgttaaaccgaaaccgggaacctaacggtacgttaacccggtataaccgggaaacctacccgggtaaaccgtaaccggacggggtacgaacttacccggtacgtaaaccgtgtaacccggaacgtacgaaaccggaacctaacaaaccgttaccggaaaccgtaaccggtaaccgtccgttaaaccgaccgttaaggggtaccgggtaggtacggtaacggccggtactagggaccgtaaagtcgacgaacgacggtcctaggttattacgtacgggttnacggtgtaacggtggtaacgggcgttaccgggtaagtaccggtaggtacttaaccggtaacgtaacctaacgtttacgttacttaaaccggg

SEQ ID NO: 150555 - DNA, 185 bp, Homo sapiens
  misc_feature: GYAE6OF02IR0Z7.13.86.H09.1.454.CMB.1.raw
  modified_base (175)..(185): a, c, t, g, unknown or other
  misc_feature (175)..(185): n is a, c, g, or t
tcagtcacgtactacacgaccggtgctcgatttagtgctatagacttgggtttggggggaagaggaagactgacggtccccccaggagttcaggtgctgggcacagcggccctgggctgcctggtcaaggactacttcctagtacgtgactgagcgggctggcaaggcgcatagnnnnnnnnnnn

SEQ ID NO: 150556 - DNA, 647 bp, Homo sapiens
  misc_feature: GYAE6OF02IRKX1.13.86.H09.1.454.CMB.1.raw
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagtcacgtactacacgaccggtgctcgatttagtgctatagacttgggtttggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctgagtgaagactctccgtgacacggtcttctaggttaccaccgtttagcagtctattcttatcgagtcgtgggtcgcgtacgacggcccctggacgaggacgtcgaggtggagtgggatggatcgacgtaccgtaacgaacggaacacgacgtactagtacggaacgacgaacctacggaggtacaagtactacacgatacgacgacanaacanacacaacgaacacacgtacctaagagtacgggagtacggaacggacgaccgtaggaacgtacgttacgaacggtaaccggacggaacccgggtccgtttaaggttacgtttaaaggttcgttaggtacggaaggtacgggtagggtaacggtcgggtacgtaagggttagtacggtaacgttaccggtaaacgtaaactttaaccgtagttaacg

SEQ ID NO: 150557 - DNA, 680 bp, Homo sapiens
  misc_feature: GYAE6OF02JQZOJ.13.86.H09.1.454.CMB.1.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtcgcccactcccaggttcagctggtgcagtctgcagctgaggtgaagaagccgtggggcctcgagtgaagactctccgtgacgaggcttctaggttacacctttagcagtctatcttactctagcgttcgggtagaccgacgaccggccccgtagggaccggacggaccgtaccggtaggtggtacgtacggggaatcgggaatccgacggaccctttaacggaaaccggaacacgagactagtaggaacacggaaccctacgacggacaagtctacacgtagcgaacgacgagacacaactacaacaacgacacgaccagacgtaggacggtagaccggagctaggacgagttacgacgtacggaacgtaccggtaacgtacggttacgttacgttgtaccggtacggtaacggttagggtacggggttaacggtacgggtaacggtaacgggttaacggttaacgtaccggttaaaccggtaaaccgtttaaaacgtttaccgttaaacggtttaaacgg

SEQ ID NO: 150558 - DNA, 700 bp, Homo sapiens
  misc_feature: GYAE6OF02GQ0OE.13.86.H09.1.454.CMB.1.raw
  modified_base (282)..(282): a, c, t, g, unknown or other
  misc_feature (282)..(282): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcattccctttcttggtggcagcagcaacaggtgcccactcccgaggttcagctggtgcagtctgcagctggaggtgaagagccgtgggcctcgagtgaagctctcctgcaggtcttcgtgttacactttagcagctatcttactcagtcgtggngccgtacgaccggtcccctagggaccgacggtaccgtcggtaggtggaggttagggattaggggacttacgaccggtaaccccttaacggaaaacccggaactaccgagtaacctacgtagggaacctaacggtaccctaccggaacgggactacggtacttaccgacgacgtacggaacgaacgacgtaacaacgactaaacacgaacgaactacgacctacgtagtacgggacgaggtacgacgtacggtagagtaattacgacgtaacgacgtacggttaccgtagttacgtttacgttacgttacgggtagtaacgggttaggtacgggttagggtaccgggtaggtaacggtacggttaaacgttacggttaacccccggtaaatttaaaccgtttaaccgttaacgttaacg

SEQ ID NO: 150559 - DNA, 798 bp, Homo sapiens
  misc_feature: GYAE6OF02JV8P5.13.86.H09.1.454.CMB.1.raw
  modified_base (313)..(313): a, c, t, g, unknown or other
  misc_feature (313)..(313): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagtctgaggtgaagaagccgtgggcctcgagtgaagatctccgtgacgaaggtctttcgtggttaacctaccgtttaggactacggtcttaacttacttacgtcacggtcgttaggggttcncggtaccgaccgggtccccgtagggaaccggtagggaccgtccggaaggtgggaggttagggggtactggggtaactaccggaaccggtaccccgttaaacgaaaaccgggaaaccaacgtacgaacgttaacgtaacgggaacctaacggaaaccccgtcggaacgggacctaagtaaccgttacccaacgtaacgtacgaaccggaaaccgacgaacctaacgtaaactaaccgaaaccggaacctaaccgacgtaccctaacggtaagtagggaaagggtacggtaacgggtaccgtaccgtaaggaaacgtacgttacgaacgaaccggaaaccgggtccgggttaacgttacggttaaacgtttaggtcggtaacgtacgggtaggtaacgggttggggtaactcggggttaaacgtaaggttagggttacccgtaggttaaacccgtaaagtttaaacgtttacggtaaccctttaagg

SEQ ID NO: 150560 - DNA, 575 bp, Homo sapiens
  misc_feature: GYAE6OF02GE4GL.13.86.H09.1.454.CMB.1.raw
  modified_base (463)..(463): a, c, t, g, unknown or other
  misc_feature (463)..(463): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtgggggcctcgagtgcgaggtccgcctgcgagggcctcgtggttactattttcgactaacgtttgcatctacgtgggtgacgacacggccccgtggcccaccggtccttggacgtcgcgtggggtgatcgtagttgttacgaacggtgacacgagtctttgacacgagtagtttggaggcagacgtccacctacgaccacgagacacactccgacgacacacgccacagtcgaactgaagatcgcgacatcgngaccgacgacggcctattatacttactgtcgacgaaggtaggttacgggtttcgggacggcggtaccgttcgttgttcgagtacgtcgggtcgggacggagggtactaacgg

SEQ ID NO: 150561 - DNA, 344 bp, Homo sapiens
  misc_feature: GYAE6OF02G29GT.13.86.H09.1.454.CMB.1.raw
  modified_base (117)..(117): a, c, t, g, unknown or other
  misc_feature (117)..(117): n is a, c, g, or t
  modified_base (298)..(344): a, c, t, g, unknown or other
  misc_feature (298)..(344): n is a, c, g, or t
tcagtcacgtactacacgaccggtgctcgatttagtgctatagacttgggtttgggtcccgccaggctccagggagggggctggagtgggtctccgctcttagtggtagtggtagtnccacatactatgctggcgccgtgaagggccggttcacccatctccagagacaattccaacaaacacactgtacctgcaaatggacagtctgagagccgaggacacggccaatatatactgtgtcgcggctgcgtatgtagtagtaccatctgcgtggggaattactactacatggactcgnnnnnnnnnnnnnnnnnnnnnnnnnnnnnnnnnnnnnnnnnnnnnnn

SEQ ID NO: 150562 - DNA, 734 bp, Homo sapiens
  misc_feature: GYAE6OF02JE56R.13.86.H09.1.454.CMB.1.raw
  modified_base (154)..(154): a, c, t, g, unknown or other
  misc_feature (154)..(154): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (446)..(446): a, c, t, g, unknown or other
  misc_feature (446)..(446): n is a, c, g, or t
tcagtcacgtactacacgaccggtgctcgatttagtgctatagacttgggtttggggacccaaaaaccacacccctccttgggagaatcccctagatcacagctcctcaccatggactggacctggagcatcctttcttggtgcagcagcaacnggtgcccactcccaggttcagctggtgcagtctgcagntggaggtanaagagcctggggccttcagtgaagtatcctcctgacgaggtctttacgtggttaccaccgtttagcagtcttactcttaactcgtaaggtccgtgggttcgccgaaccgtccgggcccccgttagggacggtaacggtaccgtacgggaggtacggtaaggtacgggtagtcggtaacgaccgtacgtacccgttaaccgaaacggtaaaccacgtagtactacgtagactacgaaccgtacggngtacgtaagtacttaccgactagacgtaacgactaacgaccgtaactaacgtaccgaaacggaactcgtaaacggccctaaacgtagtaacgggtggtaacgagggacctacggagtaagaacgtttaacgacgggaaccaccgggtaccgggttaccctaaggtttaacgttacgttagggtacccgtagggtaaggtaccgggggttaataccgggtaccgggtaattacggggacgttacggtaaaccgttcgaaaccggtttaaactttccgtaagttaaccgg

SEQ ID NO: 150563 - DNA, 824 bp, Homo sapiens
  misc_feature: GYAE6OF02H6BSW.13.86.H09.1.454.CMB.1.raw
  modified_base (291)..(291): a, c, t, g, unknown or other
  misc_feature (291)..(291): n is a, c, g, or t
tcagtcacgtactacacgaccggtgctcgatttagtgctatagacttgggtttggggacccgaaaaaccacacccctccttgggagaatcccctagatcacagctcctcaccagtggactggacctggagcatccttttctggtggcagcagcaacgaggtgcccactccccaggttcagctggtgccagtctgcagctgaggtgaagaagccgtggggcctcgagtgaagacttcgtcctgacgaaggtccttcgttggttacctacctttagactagtcttatcgttanaccgtagccgtgggtcgcgaccgtaccggccccgtaggaccggtacggtaccgtacggtaggtaggagtagggacgtcggtacgtaccgtaaccgtacccgttaaacgaaccggtaaacctacggtacgtaaccgttaagtacgggtaaccgaaaccggtaaccccgtaccggaacgggtaccctaagtaccttaacccgtaccgtaacgtaaccgggaaccgtaaccgtaaccggtaaccaaccggtaaactaaccgaaacccgaaacggaacctaccggtaaccttaaacggaccggttaggggtaaacgttacgggaaacggtacgtacccggtaagtaaccgaacgttaacggtacggaaacccggtaccggtaaccgggtttacccggttaaaggttacctttaagggttccgggtacggtaacgggtaaggttacgggtaggggttaaccccggtgggaaccggtttagggtacgttacgttaaccggaaccgtttaacctaaaagtttacccgtaagtttaaccgg

SEQ ID NO: 150564 - DNA, 578 bp, Homo sapiens
  misc_feature: GYAE6OF01DNJPK.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccggcaagtcagagcataagcaacttatttaaattggtatacaacagaaaccagggaaacgacccctaaggtcctagatctatgctgcgtcagtttgcagagcgggtccatcaagtcagtgcagtgatcgtggacagtatttcactctacaccatcagcagtctagacaacgtagaagtattttagactaacttactactgtacaactagaacgtaccaactaacccacccctaatttccctaacccgttttccgggacccccgttacggggaacccctaacggtaacggttcgggtaacgttacggtaacccgtaaacccggttaaccgttgggttaccggtccgtacggtaccccg

SEQ ID NO: 150565 - DNA, 499 bp, Homo sapiens
  misc_feature: GYAE6OF01DN1AG.33.80.H03.1.454.CMB.1.raw
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
tcagtacacacactcacgaccggtgctcgatttagctgtgcgtcgaaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactattaaattggtatcaacagaaaccagggaaagcccctaaggtcctgatctatgctgcgtcagtttgcagacgcgggtccatcaagttcagtgcagtgatcgtggacagactttcactctcacatcagcagactggagcctagaagtnttttgctagtgtattactgtcngtctagtacggtagttcattccgtcgtacgttcggaccgtaagggaccaaggtagaaatcaaacgtactgtaggctgctaacg

SEQ ID NO: 150566 - DNA, 523 bp, Homo sapiens
  misc_feature: GYAE6OF01AKR29.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaacgccccgtaaggtcctgatctatgctgcgtccagtttgcagaggcgggtcccatcaaggttcagtggcagtggatcgtggacagtatttcactctcaccatcagcagtctgaccaacgtgaagtatttgactaactttactactgtacaacagtacgtacactaacccacccattcctacgtttcccggccctagggaccctagaggtggatcgtaccaaaccggtactggtcggccgtgacccg

SEQ ID NO: 150567 - DNA, 552 bp, Homo sapiens
  misc_feature: GYAE6OF01D71WC.33.80.H03.1.454.CMB.1.raw
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
tcagtacacacactcacgaccggtgctcgatttagctgtgcgtcgaagggaaagggggaagaccgatgggtcctcggtgaaggtctcctgcaaggcctctggatacatcttcagtggctatactatcaactgggtgcgacaggcccctggacaagggcttgagtggatgggagggatcatccctataaactacccacagaaattccagggcagactcacaattaccgcgacgaatccacgagcacagcctacatggagctgaccagcctgacatctgagacacggccatgtattatgtgcgagagtctcgtcgtaatttccgttttttggagttggttataacgcccccctatcgtttccgaccccgtggggccagggaaccctggtcaccgtttcctcacgcctccaccaacggcccagtccgtccttccccctggccaccctcctcccaacgacgccacctcgtcggggcacgacgccggcccgtgggcctcgcctggtcaaggactacttccagtcgtgtgtacgtgagcgggctggcaggcganatgn

SEQ ID NO: 150568 - DNA, 523 bp, Homo sapiens
  misc_feature: GYAE6OF01DFYVL.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatacaacagaaaccagggaaagcccctaaggtcctgatctatgctgcgtccagtttgcagagcggggtcccatcgaaggttcagtggcaggtggatcgtgggacaggtatttcactctcaccatcagcagtctgacaacgtgtaagtattttgactaacttactactgtacaacgagagtacacaaccaccctattacctacgtttccgcccgtcgggaccacgtagtcggtatcgtacaaccggtaactggtcgtcgtgacccg

SEQ ID NO: 150569 - DNA, 519 bp, Homo sapiens
  misc_feature: GYAE6OF01BF4RL.33.80.H03.1.454.CMB.1.raw
  modified_base (440)..(440): a, c, t, g, unknown or other
  misc_feature (440)..(440): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatcagtgggagacagagtcaccatcacttgccgggcgagtcgggacatttacaattttttggcctggtatcagcagagagaagggaagttcctagactcctgatctatggtgcatccactttgcaatcagggtcccatctcgcttcagtggcagtggagtttgggacagatttcactctcaccgtcaccagcctgcaggctgaagtattttgctaacttattactgtacaaagtatagacagtcggcccntccacgtttccggcccttagggaccctaaaggtcggaaatacgaaaaccgtacgttacggacggactcgcgtacctacg

SEQ ID NO: 150570 - DNA, 538 bp, Homo sapiens
  misc_feature: GYAE6OF01ED8GA.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaacgcccctaaggtcctaggatctatgctgcgtccagtttgcagacgcggggtcccagtcaaggttcagtggcagtggatcgtggacagtatttcactctcaccatcagcagtctgcaacgtgaagtattttcgactaactttaactacttgtacaacagtagtaccaacaaccacccctattacctacgtttcccggaccctcggggaacccaccgaggttcggactgtacccgaaaccgaacttggtacggctggtaccc

SEQ ID NO: 150571 - DNA, 587 bp, Homo sapiens
  misc_feature: GYAE6OF01C348H.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacgagggtcaccatcacgttcggccggcaagtcagagcatcgtccgacttaattaaattggtatcagcaagaaacgaggacaacgaccctaaactcctagatctatgactgcgtcagtcgtagaccgtaaaggtccggggtaccctaagtacgtaaggttcgaaggtcggcgtaggtggagtcgtagggactaggtactttacacttcctaccgaacctatccaacgtcctagtcctagtacctaaccgtagtaacgttattttacgaacttaactttcttacgtactacaactaacgtacttaacacttcctaccgttactacggtttacgaccggtacggtaaccaaggtcgtacggaatacgtcgagtacgactggtcggtacg

SEQ ID NO: 150572 - DNA, 531 bp, Homo sapiens
  misc_feature: GYAE6OF01DFRO2.33.80.H03.1.454.CMB.1.raw
tcagtacacacactcacgaccggtgctcgatttagctgtgcgtcgaaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaacttaatttaaattggtaatcaaacaagaaaccagggaaacgcccctaaaggtcctagatctatgctgcgtcagtttgcagagcggggtccatcaaggtcagtggcagtggatcgtgggacagtattcactctcacatcagcagtctgacaacgtagtaagtattttacgactaactttactacttgtacaaacagtacgtacaaccaacctacccctattcctacgtttccggacctacgggaaccagaggtggacttcgtaccaaccgtaattcgtacgctgacc

SEQ ID NO: 150573 - DNA, 546 bp, Homo sapiens
  misc_feature: GYAE6OF01C8NPR.33.80.H03.1.454.CMB.1.raw
  modified_base (369)..(369): a, c, t, g, unknown or other
  misc_feature (369)..(369): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagggtcaccatcacttgccgggcaagtcagagcataagcaactatttaaattggtaatcaacaagaaaccgaagggaaacgacccctaaaggtcctagtactctaatgctgcgtccagttgcaggagcgggtcccagtacaaggttcagtggcaggtcggatcgngggaactagatttcaacttctcacctatccagtcaagtctgcaaacgtgtaagattttgactaacttactactagtacaaacagtatacaacaacctacccctaattccgtaaccttccggaccgtcgggtaaccacgtagtacggatcgtacaaccgtaatacgtcgctggtaacc

SEQ ID NO: 150574 - DNA, 525 bp, Homo sapiens
  misc_feature: GYAE6OF01BPB0C.33.80.H03.1.454.CMB.1.raw
  modified_base (521)..(521): a, c, t, g, unknown or other
  misc_feature (521)..(521): n is a, c, g, or t
tcagtacacacactcacgaccggtgctcgatttagctgtgcgtcgaaggggaaagggggcaggagtcagtctcagtcaggacacagcatggacatgagggtccccgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggatcctagactctgatctatggtgcatcctactttgctaatccgagggtcccatcctcgcttcgagtggctagtggtagtttgggactagtatttcacttctcaccgtcaccacgcctgcgaggtactaaagtattttgactaactttattactagtaacaaagtatagactagtcgccgctcgtctttccggcctaggaccgtaaagtagaaactcgaaacgtactacggtcggctagccacgtntacg

SEQ ID NO: 150575 - DNA, 661 bp, Homo sapiens
  misc_feature: GYAE6OF01BDIH4.33.80.H03.1.454.CMB.1.raw
  modified_base (229)..(229): a, c, t, g, unknown or other
  misc_feature (229)..(229): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagagtccaccatctcttggccggnaagtcagagcatcgtccgctaatttaaattggtatcagcaagaaaccagggaaacgcccctaaggtcctgactctatgctgcgtctagtttgcagacggccgggtcccatcgtaaggttcaaggttcggacgtaggtggtacttcggtacgggactaggtacttttccaccttaccgtaccaacctactaccgaacgcctaagttcctacgaccgtaacggtagtaaacgttattttacggaacccttaactttaacttacgttacgtacaaacgtacgtaacgtacccaaacctaaccctaacccccttaactttacccgttaacccgtttacccggtaccccggttcgggtaaaccctaaccggtccggttaacgggtaacttaccggttaacccgaaaccggtaaccggttggtccggtaccgtaccgg

SEQ ID NO: 150576 - DNA, 529 bp, Homo sapiens
  misc_feature: GYAE6OF01EP0LJ.33.80.H03.1.454.CMB.1.raw
  modified_base (227)..(227): a, c, t, g, unknown or other
  misc_feature (227)..(227): n is a, c, g, or t
tcagtacacacactcacgaccggtgctcgatttagctgtgcgtcggaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggnaagtcagagcataagcaactattaaattggtatcaacagaaaccagggaaagcccctaaggtcctgatctatgctgcgtccagtttgcagagccggggtccagtcaaggttcaggtggcaggtgatcgtggacagatttcactctcacatcagcagtctgacaacgtagaagtatttgactaactttactactgtacaacactagttacaactcttacccgtactaccgttttcggaccgtaacgggtaccaagtacgtaggtagacgtacgacggtaccgaacgtgtcggtgtgtaacccg

SEQ ID NO: 150577 - DNA, 691 bp, Homo sapiens
  misc_feature: GYAE6OF01BW7QW.33.80.H03.1.454.CMB.1.raw
  modified_base (203)..(203): a, c, t, g, unknown or other
  misc_feature (203)..(203): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatccctccctgtctgcatctagtagganacgagggtcaccatcacttcggccggacaagtcagagcaataagactaacttaatttaaattggtaactacaaacgaacggaaaaccgaacggggaaaaccgtacccccgtaaaggttccctaggtacttaccgtagtcgtcgtacgtccgttacccgtaggtttcgacgtaggacggtccgggggtaccctaagtaccgtaaacgggtttcgaaggtcggtacgtaggttagggtacgttacggtacgggtaactaaggtacttttaccaacgttcctaccaaccgtatacgacgtactacgttcgtagtaccgtaaacgttagtaaacgttagtttacgtaaccttaactttaacctacgttacgtaacctaaacgtacgtacgtaccaacctaaccctacccctaacttcccgtaccgtttcccggacccgttacggacctacgtagtcgactacgtacgaaccggtactaggtcgcgtcgtacc

SEQ ID NO: 150578 - DNA, 535 bp, Homo sapiens
  misc_feature: GYAE6OF01AY4AV.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccggcaagtcagagcataagcaactattaaatgtatcaacagaaaccaggaaacgccccgtaaggtcctgatctatgctgcgtctagtttgcagacggtccggggtacccatacgtaaggttcaggtggacaggtggacgtcgtgggactagtactttcactctcacatcagcacgtctgactaacgtgtaagtactttgactaactactactcgtacacagtatacaccaaccaccctacttacctactttcccggaccgtaccgggaccaggacgtacgagtcgtaaccaaccgtaactggtcgctgtacccg

SEQ ID NO: 150579 - DNA, 518 bp, Homo sapiens
  misc_feature: GYAE6OF01C18MC.33.80.H03.1.454.CMB.1.raw
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
  modified_base (376)..(377): a, c, t, g, unknown or other
  misc_feature (376)..(377): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagggtcaccatcacgttgccggcaagtcagagcataagcaacttaatttaaattggtatcaaacagaaaccgaggaactaccccgtaaggtcctgatctatgctcgcgtcctagttncgagngcgggtccatcaagtcagtgcagtgatgtgganagtattcactctcacnncagcatcngacacgtgtaatatttgacttaacttatactntacaatagagtacaacaaccaccctattacctaccttccgccgtacggaccaacgcgttaggacttcgaccgtaaaccgtacgtgtacgcgtcgtaacccg

SEQ ID NO: 150580 - DNA, 706 bp, Homo sapiens
  misc_feature: GYAE6OF01CNZRV.33.80.H03.1.454.CMB.1.raw
  modified_base (108)..(108): a, c, t, g, unknown or other
  misc_feature (108)..(108): n is a, c, g, or t
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagtacacacactcacgaccggtgctcgatttagctgtgcgtcgaaggggaaggggcaggagtcagtctcacgtcacggacacagcatggactatggaggtccccgntcagctcctggggctcctgctactctggcttccggagtgccagtattgtgactattccagatcgacccagtctccatccctcctgtcngcatcgtgtagagacnggtccaacgntccattcggccggcaagtcagagcctataacgcaacttaatttaatcgtaatacaacaacgaaacaagggaactacccgtaagtcctcgactactatacgctaggtcgtcgtagtttcgcgtagtacgtccggtacagtacgaaggtcgtagtcgcgtaagtggtaactcgtaggactgttacgttacaacgttcctacacctaagtacctaagactacgttacgtacgtacgtaaaccgttagtaaacgtattttccgaacttaaaccgtttaactaacgttaacgttaaccgaaacgtaaccgtaaccgttaacaaacccgttaaacccgtacccctaaccggtttaaccttaacccggttttaccggaccccggtttaaccgggaacccgtaaacggtaacccggttagggtaacgttaaccgttaaacccggtaaacccggttaaggttaccccggtacgggtccgtttaccggtaaccc

SEQ ID NO: 150581 - DNA, 626 bp, Homo sapiens
  misc_feature: GYAE6OF01B45AL.33.80.H03.1.454.CMB.1.raw
  modified_base (235)..(235): a, c, t, g, unknown or other
  misc_feature (235)..(235): n is a, c, g, or t
tcagtacacacactcacgaccggtgctcgatttagctgtgcgtcgaagggaaagggggcaggagtcagttctcagtcaggacacagcaatggacatgagggtccccgctcagctcctggggctcctgctactctggctccgaggtgccagatgtgacatccagatgacccagtcctccatccctccctgtctgcatctgtaggacgacgagggtcaccatccacgttgccggganaagtcagagcaataagactaacttatttaaattggtaatacaaacaacgaaacagggaaacgccccgtaaggtcctagactctagtgctgcgtctagtttgcgagacggcgggtccagtcgaaggtcgagtcgcaggtggactcgtaggaactagtactttccgactctaccaacctatcgacgcgtaacgtcgtacgacgtaaacggtagtaagttacgtttacgaacttaacttaacgtacgtacgtaacaacgtagtacgtaaccaaccgtaacctaccctacttaccctaccgtttcccggaccccgttagggtaaccctacgggtacggttacggtaacgtaccgtaaccgaacccgtaacgtacggtcggtaccgtacgtacccg

SEQ ID NO: 150582 - DNA, 545 bp, Homo sapiens
  misc_feature: GYAE6OF01D4LYG.33.80.H03.1.454.CMB.1.raw
tcagtacacacactcacgaccggtgctcgatttagctgtgcgtcgaaagggaaagggggcgaggagtcagtctcagtcaggacacagcatggacatgagggtccccggctcagctcctggggctcctgctactctggctccgaggtgccagatgtgacatccagatgacccagtctccatcctccctgtctgcatctgtaggagacagggtcaccatcacttgccgggcaagtcagagcataagcaactattaaattggtatcaacagaaaccaggaacgccctaacggtcctgatctatgctgtcgtcctagttgcgagacggccggggtcccatccgaaggttcagtggcagtggatcgtgggacagtactttcacgtctacaccatcagcagtctacgcaacgtagaagtgtttcgactaacttactactgtaacaacgacgtagtaccaacaacctacccctattcctacgtttcccggacccgtaggtacccagacggtgaacttcgtaacgtaaccgaacttaggtcgtctcggtaacc

SEQ ID NO: 150583 - DNA, 616 bp, Homo sapiens
  misc_feature: GYAE6OF01AXCAC.33.80.H03.1.454.CMB.1.raw
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacgaggtccaccatccacttcgccgggnaagtcagagcataagctaactaatttaaattggtatacaacagaaaccaaggaacgccccgtaaggtcctagatctatgctagcgtcctagtttcgactaggacggtccggggtaccctagtcgtaaagggttcctaggtcggacgtaggtggtactcggtaggggactagtactttacgacctctacaccagtacacgtctacgtcgtgacgtaacggtagtaacgttntttaccgacttaacgttacctattacgtaactacgtaagtaccgtaccaacccgtaaccctacccctaattccctaaccgtttccggacccgttacgggaacccaagtacggtacgactacgtaaccgaacccgttacgcgttcggctcgtaacccg

SEQ ID NO: 150584 - DNA, 659 bp, Homo sapiens
  misc_feature: GYAE6OF01DR2E8.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatcctccctgtctgcatctggtaggagacgagggtcaccatcacgttcggccgggacaagtcaggagacaataacgactaaacttaatttaaagttggtaactacaaacaacgaaaccgaagggaaaccgaccccgttaaggtcctagtacttactaagtcgtacgtcgtaccgttacctaggtttcgacgaggacgggtccgggtaccagtacgtaacggttcgaaggtggacgtaggtggacgttcggtacgggtaactagttactttccaaccgttacctacctaacctataccgacgtctaacgttcgtcgaaccgtaaggtacgtaagttacttttacgaacttaacttactactacgtacaaactactacgttaactacgttacctaccgtaacttaccgttcggaccggtaacggaccgtaacgtgtacggtacacgtacggaacggtaccgtaagttggacgtcgtcgtaacccg

SEQ ID NO: 150585 - DNA, 817 bp, Homo sapiens
  misc_feature: GYAE6OF01A44YP.33.80.H03.1.454.CMB.1.raw
tcagtacacacactcacgaccggtgctcgatttagctgtgcgtcgaagggaaagggggcaggagtcagtctcagtcaggacacagcatggacatggacgggtccccgctcagctccgtggggctcctgctactctggctccgaggtgccagatgtgacatccgagatcgacccagtcctccactccctcctgtctgctatcgtaggtaggacgacgtacgggtaccaaccgtatccgtaccgttcgggcccgggaactaacggtcgaaggacgactaagtaacgaacttaaactttaagtttaaagttacgtaactaacgaaacgtaaaccggaaaccgaacggggtaaaccctaccccgtaaggttccctagtactcgtagtcgtccgtcgtccgttcgtagttcgacggacggtaccgggtccgggtacctagtacgtaacggtcgaggtcggagtaggtgacgtacggtagggaactaggttaccttaccacctaccgtactaaccctattacccggaacgtaccgtacgttacccgtaacggaaccgtttaaacgggttacgttaaaacgttttaccgtttaaccggaaacccttttaaacccgtttcgttaaaccgtaccggtaaacaacccgggttaataacccgttaacccaaaccctaacccccgttacttaccttaacccgggttaccccgttcccgggaacccgttacccgggtaaacctaaggggtacggttaacccgtaggttaaaccccggttaacccgtaacccgggttagggttaccgggtacgaccccttacggtaacccc

SEQ ID NO: 150586 - DNA, 656 bp, Homo sapiens
  misc_feature: GYAE6OF01BDNZA.33.80.H03.1.454.CMB.1.raw
  modified_base (229)..(229): a, c, t, g, unknown or other
  misc_feature (229)..(229): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatcctccctgtctgcatctgtaggagacgaggtcaccatcacgttcgccgggnaagtcagagcaataagactaacttaatttaaagttggtatacaaacacgaaaccgaagggaaacgaccccgtaaggtcctagatctatgctgcgtctagtttgcgaggacggccggggtcccagtcgtaaggttcgaggtcggacgaggtgtagtcgtagggactaggttactttccgtaccttcctaccaaccctataccgacggtacacgttcctaggacctaacggtacgtaagttacttttacggtaacctttaaccctttaacgttaaccttacgtaacctaaacggacgttaaccgtaaccaaaccccgtaacccaccccgttacttacccgttaccgttcccggtacccggttacggacccgtaactaggtacgtacgtacgttacccaacccggttacgtaggtccgtcgtcgtacccg

SEQ ID NO: 150587 - DNA, 702 bp, Homo sapiens
  misc_feature: GYAE6OF01BK78I.33.80.H03.1.454.CMB.1.raw
  modified_base (106)..(106): a, c, t, g, unknown or other
  misc_feature (106)..(106): n is a, c, g, or t
  modified_base (203)..(203): a, c, t, g, unknown or other
  misc_feature (203)..(203): n is a, c, g, or t
tcagtacacacactcacgaccggtgctcgatttagctgtgcgtcgaagggaaagggggcaggagtcagtctcagtcaggacacagcatggacatgagggtccccgntccagctcctggggctcctgctactctggctccgaggtgccagatgtgacatccagatgacccagtctccatccctccctgtctgcatctgtagganacgaggtcaccatccacttcggccggcaagtcagagcataagacaaacttatttaaattggtatacaaacaacggaaaccaaggaaacgccccgtaaggtcctgactctatgctcgcgtcctagttgcaggacggccggggtccctagtacgtaacggttccgaggtcggacgtagggtggtacgttcggaggggaactagttacgtttaccacttctaccctaacctacttccgaaagtccgtaagttcctacggtaaccgtaacggtaagtaagtttacttttacggaacccttaaacctttaccgttactaccgttaaccgaacgtaacggtaccttaaccgaaaccctaaccccctaaccccttactttaccccgttaccggtttccccggacccccggttaacgggaaccctaccggtaagggttacggtaaccgtttaccggtaaacccggtaaacccgtaaccgttgggtccgtaccgtccgtaaaccccgg

SEQ ID NO: 150588 - DNA, 758 bp, Homo sapiens
  misc_feature: GYAE6OF01CSLBJ.33.80.H03.1.454.CMB.1.raw
  modified_base (476)..(476): a, c, t, g, unknown or other
  misc_feature (476)..(476): n is a, c, g, or t
  modified_base (753)..(753): a, c, t, g, unknown or other
  misc_feature (753)..(753): n is a, c, g, or t
  modified_base (758)..(758): a, c, t, g, unknown or other
  misc_feature (758)..(758): n is a, c, g, or t
tcagtacacacactcacgaccggtgctcgatttagctgtgcgtcgaagggaaagggggaagaccgatgggtcctcggtgaaggtctcctgcaaggcctctggatacatcttcagtggctatactatcaactgggtgcgacaggcccctggacaagggcttgagtggatgggagggatcatccctataaactacccacagaaacttccgagggcagactcacaagttaccgcggacgaatccacgagcacacgcctacatggacgctcggaccaggcctagacatcctagacggacgaccggccattgttattagttgtgcgtagtacgtcgtacgttcgtaacgtttttccggttttttaggaggttagggtttaactaacccgtcccccccgtaagtttccggtttacccgtacccccggtcgggggtacccgaacggggttaaaccccgttcggttcccgtacccgtttttccnccgtaccgtccccgtacccaccgggaaccggtacccctacggttccccggttcccttcccccggtcggtcccctaacccgtcccctaaccgtacggaccgtaccctacccggtccgggtacggggtcccaaccggacgggtcccgggcccccggttcgggacctcccgggttcctacgggtacccggtaacggtccttaccgttacccggttagttcgggttcgtaggttaccggtggacggggtcggccggttaaggccggacggtccgagtaacnggtgn

SEQ ID NO: 150589 - DNA, 682 bp, Homo sapiens
  misc_feature: GYAE6OF01D8S38.33.80.H03.1.454.CMB.1.raw
  modified_base (579)..(579): a, c, t, g, unknown or other
  misc_feature (579)..(579): n is a, c, g, or t
tcagtacacacactcacgaccggtgctcgatttagctgtgcgtcgaagggaaagggggcaggagtcagtctcagtcaggacacagcatggacatggagggtccccgctcagctccgtggggctcctgctactctggctccggaggtgccagatgtgacatccagatcgaccagtcctccatccctcctgtcctgcatctgtaggagacgacgggtcaccatcctacgttcggccgggacaacggtcaaggtacgactaagtaacgtacctaaacttaagttttaaaagtttaggttaactaaccgtaaaccgaaacggaaaacccggaacggggtaaccctaaaacccggtaaccccctttaaaaccgttcccgtaggtaaccgttactaacgtcgtaccgttcgtaccgtacctacggttctacggacgtaaggtcgggtacctaagtacgtaacggttcgaggtacggacgtaggtagagttcggaggtactagttacttcgacccttcacgtaaccagtccgaatcgtacgtctaacgtactacgtagtagttacttcgaacttaactacgtctanacaagtagtactacaacgaccctccgtaacttccgtaccgttccgacccggagtacccaggtcgttacgaataccgaccgtaacggctgggtcctgtaacccg

SEQ ID NO: 150590 - DNA, 772 bp, Homo sapiens
  misc_feature: GYAE6OF01B2P75.33.80.H03.1.454.CMB.1.raw
  modified_base (190)..(190): a, c, t, g, unknown or other
  misc_feature (190)..(190): n is a, c, g, or t
tcagtacacacactcacgaccggtgctcgatttagctgtgcgtcgaagggaaaggggcaggagtcagtctcagtcaggacacagcatggacatgacggtccccgctcagctccgtgggctcctgctactctggctccgaggtgccagatgtgacatccagatcgacccagtcctccactccctcctgtcncgtcatcgtggagagacgaggtccacgatcctacgtcggccggacgaagtcgagagacaataacgactaacttaatttaaacgtgtaactacgaaacgtaacgaaaaccggaacgggaaaacccgtaccccgtaacgttaccctagtaacttactacgtttcgacgtaccggtaccgtcccgttaaggttaccggaaccgtaacgggtaccgggtaccccggggttaaccctaagtaacccgggttaaacggtcgtaagggtacggtacgtaccggtaggtacgtacccggtaagggtacctaagttactttcccgaccttaccgtacctactacgtacgtacgacgttaacgtaccggtagaactaacggttacgtaaagtttacgtttaccgaacgtttaaccttaacgtaacgttcgtaaccaacgtaacgtacccgttaacaacccgaaccccttaacctccgtttaacctacccggtttacccctacccgggtacgtaaacccgtagtacggttaccgggttactaaccggtaaccccgtaaaccggtcgtaaccgtcggacgtttacccggacccc

SEQ ID NO: 150591 - DNA, 860 bp, Homo sapiens
  misc_feature: GYAE6OF01CMOG2.33.80.H03.1.454.CMB.1.raw
  modified_base (154)..(154): a, c, t, g, unknown or other
  misc_feature (154)..(154): n is a, c, g, or t
  modified_base (159)..(159): a, c, t, g, unknown or other
  misc_feature (159)..(159): n is a, c, g, or t
tcagtacacacactcacgaccggtgctcgatttagctgtgcgtcgaagggaaggggcaggagtcagtctcagtcaggacacagcatggacatgacggtcccgctcagctccgtgggctcctgctactctggctccggagtgccagatgtcgacntcagntcgaccagtcctcctatccctccgttgtctgacctattcgtagtaggacgaccgtacgggtaccacctagtacctaacgttccggaccgggaactaaacggttcgaaggaccggtactaaacggtaaactacgtttaaaacctttaaagttttaaacgttacggttaaacttaaccgaaaacggtaaccggaaaaccggtaacggggtaaaacccgtaccccggttaaacggttcctacgtaaccgtttactaacgtcgtcgtaccgtccgttaacgttacgtttacgacgtaccgggtaccggtaccggtaccctagtaacggttacggtacgtaggtccggagtaacggtaggtacgtcggtagggtactaggtactttccacgtctaaccacgtctaaccgagtaacgtcgtaacgtaccgaacggtaaccgttaagtaacggtttacttaccggtaaactttaccgtaacccttacggttaaactaaccgttaaacgaccggttaaccttaacccggaaaccccttaacccttaacccgtacctttaaccccggttttaacccgggtacccccgtaccggtttaccccggaaaaccgttcccggttaagggttaaacccgggtctttaaaacccgggaccccttaaacccggggttcgttaaaccgggttccctaccgggtttacccctaaaccggg

SEQ ID NO: 150592 - DNA, 705 bp, Homo sapiens
  misc_feature: GYAE6OF01BK4AE.33.80.H03.1.454.CMB.1.raw
  modified_base (231)..(231): a, c, t, g, unknown or other
  misc_feature (231)..(231): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatccctcctgtctgcatctgtagagacaggtcacatcactgccggacagtcaganacataagactaacttaatttaaagttgtaatacaaacaagtaaaaccgacgggaaacgaccccgtaaggtcctagtatacgtatcgctcgacgtccgtagttcgacgacggtacggaccgggtacctaacgtaccgtaaggttaccgtaggtacggacgtaggtaggtacgttacggtaggtaactacggttactttaccgtaccgttacctaccgtaacctaactaccgtaagaccgtacgttacgtacgtaacgtaaacgttacggtaaacgtttactttaacgaacctttaaacctttacgttaacgtacgtaacgtaaacgtacgtaaccgttaccaaacccgtaaccctaacccgttacgttaaccgttacccgttttacccggacccgttacggaccctaacggtacggttacgtaccgttaaccggaaccgtaaaccggtaccgtaggtaccggtcctcgtaacccg

SEQ ID NO: 150593 - DNA, 775 bp, Homo sapiens
  misc_feature: GYAE6OF01BJO9O.33.80.H03.1.454.CMB.1.raw
  modified_base (224)..(224): a, c, t, g, unknown or other
  misc_feature (224)..(224): n is a, c, g, or t
  modified_base (551)..(551): a, c, t, g, unknown or other
  misc_feature (551)..(551): n is a, c, g, or t
tcagtacacacactcacgaccggtgctcgatttagctgtgcgtcgaagggaaaggggcaggagtcagtctcagtcaggacacagcatggacatgacgggtccccgctcagctccgtgggctcctgctactcgtggctccgaggtgccagatgtgactactaccagtatcgaccctacgtcctcccctaccctccctgtcctcgtctacgtcgtggtaccggaanaccgacgtacgtaccaacctagttccgtccggttccggccgggtaacgaacgtccgaagaccgccgtaacgttcccgttaccggttaactttaaagttttaaaagttcggtaactccgaaggtaccgaaacgtaaaccggacgggtaacctaacccgtaacccctaaaccttcggtaacgtacttacgttatccggtacgtcgtcctacctggttaccgagacgtaaacggtccggtacctaggtacgtaaggtcgagtggacgtaggtacggtatcgggtacggtataaccgttcttccgacttacccctagtacctactaccggngtacctacgtacctacggtaaacctcgtttaacgtaccgttactttaacggacccttttaagttcctaacgttacgtaaacctaccgttaaacttaccgttaaactacccgtttacccggtacccgtttaaccgtaccgggttaaccggaaccggtaaccggttaccaggtaacggtcgtaacgtacgtaacccggacgtaaggtccgttaaagccggttaccg

SEQ ID NO: 150594 - DNA, 750 bp, Homo sapiens
  misc_feature: GYAE6OF01A7BVV.33.80.H03.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtcctccactcctccctgtcngcatctagtaggagacgaggtcaccatcacgttcggccgganaagtcagagacaataacgactaaacttaattttaaagttaggtaactaccaaaacgaacggtaaaaccggaagggaaaccgtaccccgtaaaggtcctaggtaacttctagtcggtacgtcgtaccgtaccgttacggtttcgaccgaggtaaccgggtccggggtaccctaacggttacggtaaacggttccgaggtcggaacgtacggtaggtacgtacgggtagggaactagttacgtttactaccgtacctaccgacctagtacgacgtaccgtacgtacgtacgacgtaacggttagtaacgtttactttacgtaaccctttaaaccgttacttaacgttacgaaccctaaacggtacggtaaccgtaacaaacccccgtaaacccttacccgtacgtttacccgttaaaccccggttccggttacccccggtagggaaccccttaggacggttaacgttacgtaaccgtacccgtaaaacgtaccgttaggaacccgttgtccgtaaaccc

SEQ ID NO: 150595 - DNA, 680 bp, Homo sapiens
  misc_feature: GYAE6OF01BTXWS.33.80.H03.1.454.CMB.1.raw
  modified_base (517)..(517): a, c, t, g, unknown or other
  misc_feature (517)..(517): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtcctccactccctccctgtctgcatctaggtaggagacgaggtcaccatccacgttcggaccggtacaagtcgagacgcataacgactaaacttatttaaagtcggtaactacgaaacgaacgaaaccggaagggtaaacccgtaccccgtaacggttcctaggtaacttacttaagtcgccgttacggtccgtaccgttaggtttcgacgtacgggaccgggtccggtaccctagtacgtaacggtcgtaggtcggtacgtaggtacggtacgtcggtaggaactaggttacttaccacgttcctaccacgtataccaggtctacgtacacgtacgtaacggttnaacgtttcttacgaacttactaccgtatcgaacaacgtcgtaactaccgaaccctaacctacccgttacctaccgttacccgttcccgggacccgttacggaccgtacgtacggtacgtaccttacggtaacccgtaacgtagtccggtacgtcaccggtacc

SEQ ID NO: 150596 - DNA, 676 bp, Homo sapiens
  misc_feature: GYAE6OF01BUM9N.33.80.H03.1.454.CMB.1.raw
  modified_base (235)..(235): a, c, t, g, unknown or other
  misc_feature (235)..(235): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtcctccatcctcctgtctgcatctgtaggacgacgacggtcacatcacgttgccggcaagtcagngcataagctaatattaatgtatacaacagaaccgaggaacgcccctaaggtcctgactcgtatcgcgtcgtcgtactaggtttcgacgacggtacggccggggtaccctagtaccgtaaaggttccgaggtcggacgtacggtaggtacgtcgtacgggaactacgttacgtttaccgaaccttccgtaccaaccggtactaccgaacgtccgtacgtaccgtagaacccgtaacggtacgtaaacgtttacgttttaccgaaccctttaaccgtttacttaaccgttacgtaaccaaccgtaagttaccgaacctaaccctaaccgtaccccttagtttacccgttaccgtttccgggaccccgtacgggtaaccctacggtaaggtcggacttaccggtaccgtaaacccgttaacggttcgtacggtccttcggaccc

SEQ ID NO: 150597 - DNA, 728 bp, Homo sapiens
  misc_feature: GYAE6OF01A6RYZ.33.80.H03.1.454.CMB.1.raw
  modified_base (224)..(224): a, c, t, g, unknown or other
  misc_feature (224)..(224): n is a, c, g, or t
tcagtacacacactcacgaccggtgctcgatttagctgtgcgtcggaagggaaagggggcgaggagtcagtctcagtcaggacacagcatggacatgacgggtccccgctcagctcctggggcctcctgctactctggctccggaggtgccagatcgtgacatccagatcgacccagtcctccactcctcctgtctgcatctgtaggagacgagggtccaaccntaccacgttcggaccgggtacaacggtcaaggtacgactaagtaaacgactaaacttaatttaaacgttcggtaactacgaaaacgtaacggaaaacccggaaacgggaaaaccgtaacccccgttaaaggttaccctagtaacttctaagttagcctagtaccgtaccgtaggtttcgaccgtaggtaccggccggggtccctaagtacgtaaggttcacggtggactaggtacggtagtccggtaggtacagttactttaccacttactacacctacgtcaacggtcaagttccgagtacgaacggtagtaacgttacttttcgaaccgtttaacttacgtacttacgtaacctaacgaggttacctaccgtaacaaacccctacctaactttcctaaccgtttcccggtacccgtaagggaccccttacggacggttacgggtaaccttccgggttaaaccctaaaccgggtacgttaaggtcccggtccgtcgtaacccg

SEQ ID NO: 150598 - DNA, 703 bp, Homo sapiens
  misc_feature: GYAE6OF01A8YKL.33.80.H03.1.454.CMB.1.raw
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
tcagtacacacactcacgaccggtgctcgatttagctgtgcgtcgaagggaaagggggcaggagtcagtctcagtcaggacacgagcatggacatgagggtccccgctcagctcctggggctcctgctactctggctccgaggtnccagatgtgactatccagatcgacccagtctccatccctcctgtctgcatctggtacgganacgacgggtcaccatccacgttggccgggacaagtcagacgcaagtaacgactaacttaatttaaagtggtaactacaaacaacgtaaaccgaagggtaaacgacccccgttaaggtcctggaacttcgtaacgtcgcgtcgtaccgtactagtttcgacgagacggccggggtaccctaagtcgtaacggtcgtaggtcggtactaggtacggacttcggagggtaactacgttacttaccgactctaccgacctaatccgtaacgtcgtaacgtcgtacgtaccgtaacggtagtaaacgtacttttacgaaccgttaactttacggttaacctacgttaaccgaacgtaccgtacgttaaccccaaccgtaacccctaccccttaacgttccgtaccggtttcccggacccgtaccgggaacctacggtacggtcggtaaccttacgtaacccgtaaaccggttacggttaggtcccggtcgttacgtaccccg

SEQ ID NO: 150599 - DNA, 857 bp, Homo sapiens
  misc_feature: GYAE6OF01DZKSS.33.80.H03.1.454.CMB.1.raw
  modified_base (107)..(107): a, c, t, g, unknown or other
  misc_feature (107)..(107): n is a, c, g, or t
  modified_base (597)..(597): a, c, t, g, unknown or other
  misc_feature (597)..(597): n is a, c, g, or t
tcagtacacacactcacgaccggtgctcgatttagctgtgcgtcgaagggaaagggggcaggagtcagtctcagtcaggacacagcatggacatggagggtccccgntcagctccgtggggctcctgctactctggctccggaggtcgcagtatgtgacactcgagatcgacccagtcctaccactccctcctgtctgctagttccgtaggtaggaacgaccggtacggtaccaaccgtacttcgtaaccggttcggacccgggaactaacggtaccgaacggtacgacgttaccggttcccgtacccgttaagttttaaaattttaacgggttcggtaactaccgtaacggaaccggaaaaccggaaaaccggttacgggaacccaaaccccggttaaccccttaaacgtccgtacgtactttacgtcgtcgtcgtacgtccgtaacgcgtacgtacaacggtaacggttcggtacccaagttaaccggaggttacgtacgggataccggtaggtacggtaacgtcgggtaagtaccgttaagttcctttaaccgacgttcccctacggtacccacccggtacaacggttccgtanaccgggtcgttaacgtaacgggttaattttaccggtacctttaaacttaacgttttaactaaccggtttaaagaaacgttaaacgttggtaaccgtacggttacccggtccggtaaccccgttaccggttacccgtttacccggtaaccgggaacccgttaaaccggggtaaaccttaaacgggtaaaccgtaaaccgtaaacccgggtacgtttaaacgggtcggtaaaccccgacggttccgaaaccgtttacccggg

SEQ ID NO: 150600 - DNA, 497 bp, Homo sapiens
  misc_feature: GYAE6OF02I7AG1.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaacgcccctaaggtcctgatctatgctgcgtccagtttgcagagcggggtcccatcaaggttcagtgcagtgatcgtgggacagatttcactctcaccatcagcagtctgcaacgtgaagtattttgactaacttactactgtacaacagagtaccaacaaccaccctattccactttcgaccctgggaccacagtgatgacaaccgatggtcggtctgcc

SEQ ID NO: 150601 - DNA, 488 bp, Homo sapiens
  misc_feature: GYAE6OF02HSPD2.33.80.H03.1.454.CMB.1.raw
  modified_base (258)..(258): a, c, t, g, unknown or other
  misc_feature (258)..(258): n is a, c, g, or t
tcagtacacacactcacgaccggtgctcgatttagctgtgcgtcgaagggaaaggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagggtcaccatcacttgccgggcaagtcagagcataagcaactatttaaatggtatnaacagaaaccagggaaagcccctaaaggtcctgatctatgctgcgtccagtttgcagagcggggtcccatcaaggttcagtggcagtggatcgtggcagatttcatctcaccatcagcagtctgcaacgtgaagattttgactaacttactactgtacaactagagtacacaaccacccattccactttcgccctgggaccacagtgatgtcaaccgactgtggctgacc

SEQ ID NO: 150602 - DNA, 565 bp, Homo sapiens
  misc_feature: GYAE6OF02ILEXU.33.80.H03.1.454.CMB.1.raw
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
tcagtacacacactcacgaccggtgctcgatttagctgtgcgtcggaagggaaagggggcaggagtcagtctcagtcaggacacagcatgggaccatgagggtccccgctcgagctcctggggctcctgctactctggctccgaggtgccagatgtgacatccagatgaccccagtctccatcctcctgtctgcatctgtagganacagggtcaccatcacttgccgggcaagtcagngcataagcaactatttaaatggtaatcaaacacgaaaccagggaaacgcccctaaggtcctagatctatgctgcgtactagtttgcagacgcgggtccatcaggttcagtggcagtgatcgtggacagtactttcgactctacaccatcagcagtctgtacaacgttgaagtattttacgactaactactactacgtacaactagacgttacaaccgtaacctaaccctagttacctaacgtttcccggacccgttagggtaaccctaaccgtaggtacgtacttacggtaccaaccggtacgtacggtggtaccgttacgtacccg

SEQ ID NO: 150603 - DNA, 524 bp, Homo sapiens
  misc_feature: GYAE6OF02HCB87.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaagcccctaaggtcctgatctatgctgcgtccagtttgcagagcggggtcccatcaaggttcagtggcagtggatcgtgggacagtatttcactctcaccatcagcagtctgtaacgtgaagtattttgactaacttactactgtacaacagacgtacaacaaccacccattcctacctttccggcccttagggacccaacgagtcggaattcggtacaaccggtaactggtacggctagcctaaccg

SEQ ID NO: 150604 - DNA, 534 bp, Homo sapiens
  misc_feature: GYAE6OF02GDSJ0.33.80.H03.1.454.CMB.1.raw
  modified_base (205)..(205): a, c, t, g, unknown or other
  misc_feature (205)..(205): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctcccagataccaccggggaaattgtgttgacacagtctccagccaccctgtctttgtctccaggggaaangccaccctctcctgcagggccagtcagagtgctggcagcaacttagcctggtaccagcagacacctggccaggctcccaggcctcctcatccatggtgcatccaccagggcccacgtggcactcccagactaggttcagtggcaggtcgggtctggggacagtaccttcacttctcaccatcagcagactggacgcctagaagtagttttgctagtgtattactgtacagtctaggtacggttagttcacttctccgtacgttcggaccgaagggtaccgaaggtacggaaactacgaaacgtacgtaggtaggactacgaccactacg

SEQ ID NO: 150605 - DNA, 494 bp, Homo sapiens
  misc_feature: GYAE6OF02GOJXT.33.80.H03.1.454.CMB.1.raw
  modified_base (422)..(422): a, c, t, g, unknown or other
  misc_feature (422)..(422): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccaggaaagcccctaaggtcctgatctatgctgcgtccagtttgcagagcggggtcccatcaaggttcagtgcagtggatcgtgggacagatttcactctcacatcagcagtctgacaacgtgaagtatttgactaacttactactgtacaanagagtcaacaaccaccctattacctacttccgcctacggaccacgagtgatgtacaacgactgtcgctgacc

SEQ ID NO: 150606 - DNA, 536 bp, Homo sapiens
  misc_feature: GYAE6OF02GAXV2.33.80.H03.1.454.CMB.1.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
tcagtacacacactcacgaccggtgctcgatttagctgtgcgtcgaagggaaagggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaatggtttcagcaagaaaccagggaacncccctagactcctgattcacgaggcatccaattacggaaatacggggtcccaagaaggttcaggtggaggtgagcgtgggacagtactttacccncaccatcagcagcctgcagcctagaagatcttagacaactattattactgtacaactagtaataataacttcctacccgtactacgttttcggacctagggaccaagtctagggatacgtacaaacgtactggtagactacgactaccatctgtactacg

SEQ ID NO: 150607 - DNA, 502 bp, Homo sapiens
  misc_feature: GYAE6OF02IC2XC.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaaacagaaaccagggaaagcccctaaggtcctgatctatgctgcgtcagtttgcagacgcggggtcccatcaaggttcagtggcagtggatctgggacagatttcactctcacatcagcagtctgcaacgtgaagattttcgataacttactactgtacaacagagtacaacaaccacccattccactttccgcctacgggaccacgagtcgtatgtacaaccgacgtacggtgctgaccg

SEQ ID NO: 150608 - DNA, 511 bp, Homo sapiens
  misc_feature: GYAE6OF02J0UPU.33.80.H03.1.454.CMB.1.raw
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (476)..(476): a, c, t, g, unknown or other
  misc_feature (476)..(476): n is a, c, g, or t
tcagtacacacactcacgaccggtgctcgatttagctgtgcgtcgaaggtaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacaggtcaccatcacttgccggcaagtcagagcataagcaactattaatgtatcaanagaaaccaggaaacnccccgtaaggtcctagactctatgcgtgcgttccagtttcgctagagccggggtcccagtacgtaaggttcaggtggacgtagtaggatcgtagggacagtattcgactctacacatcgatcgatctagacagttagaagtatttgactaactactactgtacacagagtcaacacctaccatcctacgttcgccgtagaccngtagtcgatcgtacgaaccgagtgtcgcctgtacc

SEQ ID NO: 150609 - DNA, 522 bp, Homo sapiens
  misc_feature: GYAE6OF02HAAUF.33.80.H03.1.454.CMB.1.raw
  modified_base (440)..(440): a, c, t, g, unknown or other
  misc_feature (440)..(440): n is a, c, g, or t
tcagtacacacactcacgaccggtgctcgatttagctgtgcgtcgaagggaaagggggcaggagtcagtctcagtcaggacacaagcatggacatgagggtccccgctcaggctccgtggggctcctgctactctggctccgaggtgccagatgtgacatccagatgacccagtctccatcctccctgtctgcatctgtaggagacagggtcaccatcacttgccgggcaagtcagagcataagcaactatttaaattggtatacaacagaaaccagggaaacgcccctaaggtcctagatctatgctgcgtccagtttgcagagcggggtacccatacaaggttcagtgcagtgatcgtggactagtatttcacttctcactatcagctagtctagactaacggtagaagtattttagactaacttactactgtacaanagtagtactacaaccacccattaccactttccgccgtacggcctacgagtcgatcgtacaaccgtactcggagtctgtaccg

SEQ ID NO: 150610 - DNA, 558 bp, Homo sapiens
  misc_feature: GYAE6OF02G1ENZ.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttggccgggcaagtcagagcataagcaacttatttaaattggtatacaacaagaaaccgaaggaaacgaccccgtaaggtcctgatctatgctgcgtccgtagtttgacaggacggccggggtacccagtcgtaaggttcgaggtggcaggtaggatcgtagggacagtactttcactcctacaccatcagcagtctcgactaagtgaagttatttcgactaaccttactaacgtgtaacaacgagacgtaccaaccaaccacccacttacctacttccggaccctacgggaccacgtacggtagtactcgtaccaaccgtacgttcggtcggtctgaccc

SEQ ID NO: 150611 - DNA, 583 bp, Homo sapiens
  misc_feature: GYAE6OF02FMDKM.33.80.H03.1.454.CMB.1.raw
  modified_base (245)..(245): a, c, t, g, unknown or other
  misc_feature (245)..(245): n is a, c, g, or t
tcagtacacacactcacgaccggtgctcgatttagctgtgcgtcgaagggaaagggggcgaggagtcagtctcagtcaggacacagcatggacatgagggtccccgctcagctcctggggctcctgctactctggctcccgaggtgccagatgtgacatccagatgacccagtctccatcctccctgtctgcatctgtaggagacagggtcaccatcacttgccgggcaaagtcagagcataagnaactatttaaattggtatcaacagaaccaggaagcccctaaggtcctgatctatgactgcgtcgagtttgcagagcggggtccatcaaggttcagtggcagtagatcgtgggacagtatttcactctcaccatcagctagtctagtaacgttgaaagtacttttacgctaaactttactacttagtccaacgtagagttacacgtaaaccaccccctaagtttaccacgttttcccggtacccgttaccgggaacccgtcgaacggttcgggtaagttacggttaacccgtaaacccggtaaacgttacggttgggtacccttcggaacctaaccccg

SEQ ID NO: 150612 - DNA, 520 bp, Homo sapiens
  misc_feature: GYAE6OF02GI7CJ.33.80.H03.1.454.CMB.1.raw
  modified_base (425)..(425): a, c, t, g, unknown or other
  misc_feature (425)..(425): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaagcccctaaggtcctgatctatgctgcgtccagtttgcagagcggggtccatcaaggttcagtggcagtggatctgggacagatttcactctcaccatcagcagtctgcaacgtgaagtattttgactaactttactactgtacaaanagagtcaacaaccacccctattccaacgtttccggaccctgggaacccacgtacggtggactggtaccaaccggtaactggtcggtactgtaccc

SEQ ID NO: 150613 - DNA, 617 bp, Homo sapiens
  misc_feature: GYAE6OF02IBYR6.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagggtcaccatcacttgtcggcaagtcagagcataagacaactaatttaaattggtaatacaaacaagaaaaccgaagggaaaacgacccccgtaaaggtccctagactctaatgctgcgtcctaagtttgcaggacggccggggtacccagtacgtaaggttcaggtggactaggtggatcgtagggactagtactttcactctaccacatcagcagtctcgactaacggttgtaagttactttagacctaaacgtttactacgttacgtacaactagtaacgtaccaaaccgaacctaccctaattaccgtaccgtttacccgggaccccgttagggaacccctaacgacggttacggtaacgttaccggttaccgaaaccggtaaccgttgggtaccggtacctaggtaccc

SEQ ID NO: 150614 - DNA, 526 bp, Homo sapiens
  misc_feature: GYAE6OF02HH0CU.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactattaaattggtatcaacagaaaccagggaaagcccctaaggtcctgatctatgctgcgtcagtttgcagagcggggtccagtcaaggttcagtggcaggtggatcgtgggacagtatttcactctcacctatcagctagtctgacaacgtgaatatttcgactaacttactactgtacaacagatacaacaaccaccctaattccacctttccggcccttacgggaaccctacgacggttacggatcggtacctaaccggtacgtggtacggctgtaccc

SEQ ID NO: 150615 - DNA, 516 bp, Homo sapiens
  misc_feature: GYAE6OF02HS3PK.33.80.H03.1.454.CMB.1.raw
  modified_base (388)..(388): a, c, t, g, unknown or other
  misc_feature (388)..(388): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaaactatttaaaattggtatcaaacagaaaccaggaaagcccctaaggtcctagatctatgctgcgtccagtttgcagagcggggtcccatcaaaggttcaggtgcagtggatctgggacagatttcactctcaccatcagcagtntgccaacgtagaagattttgactaactttaacctacttaggtacaactagagtacaacaaccaacccacttcacctttcggcccttgggaccacgtaggtcgtatgtacaccgaactgtcggctgacc

SEQ ID NO: 150616 - DNA, 530 bp, Homo sapiens
  misc_feature: GYAE6OF02HAXX5.33.80.H03.1.454.CMB.1.raw
  modified_base (355)..(355): a, c, t, g, unknown or other
  misc_feature (355)..(355): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagggtcacatcacttgccgggcaagtcagagcataagcaactatttaaattggtatcaacagaaaccagggaaagcccctaaaggtcctgatctatgctgcgtccagtttgcagagcgggtccatcaaggttcagtgcagtggatctgggacngtatttcactctcaccatcagcagtctagcaacgtgaagtatttcgactaacttactatacgtacaacagaagtcaaccaaccacccctattacctacgtttcccggacccgttcgggaaccctaacgacggttggaacttcgtaccaaccggtacgtcggtcggtctggaaccc

SEQ ID NO: 150617 - DNA, 531 bp, Homo sapiens
  misc_feature: GYAE6OF02H8SCN.33.80.H03.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagggtcaccatcacttgccgggcaagtcagagcaataagcaactatttaaattggtatacaacagaaaccagggaaancccctaaaggtcctgatctatgctgcgtcagtttgcagagcggggtcccatcaagtcaggtggcagtggatcgtgggacagtatttcacttctaccacctatcagcagtctgcaacgtnaagtatttcgactaacttacttntagtacaacactagttacaattcctaccgtactacgtttgaccgtagggtacccgaagtccgtaggactagtaccgaggtacgaaacgttggtagtccgtaggtaccc

SEQ ID NO: 150618 - DNA, 542 bp, Homo sapiens
  misc_feature: GYAE6OF02GQYOE.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccggcaagtcagagcataagcaactatttaaattggtatcaacagaaaccagggaacgcccctaaggtcctagatctatgctgcgtcctagttcgcaggagcgggtcccatcgaaggttcagtgcgagtggatgtgggacagtattcactctacaccatcagcagactagagccgtagaagtattttgactagttgtatttacgtacgttcagtctaaggttacggttagttacgtacttcgtaccgtacgttcggaccgaacgggtaccgtaagggtagtaaacgtaccgaaacgtacgtacgtaggactacgactaaccg

SEQ ID NO: 150619 - DNA, 587 bp, Homo sapiens
  misc_feature: GYAE6OF02HXLCP.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatcctcctgtctgcatctgtaggagacgacgggtcaccatcacttggccggacaagtcagagcataagacaactatttaaattggtaatactaacaagaaaccgaagggaaacgacccccgttaaaggtcctagactctaatgctgccgtacctagtttgcgagacggccggggtcccagttacaacggttcaggtggacacggtggatcgtggggacagtactttcactctccacctatcagctagtctgactaagtagagtatttcgactaactactactcgtaacaacagacgtaccaacaacctaacccacttacgtaccctttaccggcccgtacgggaaccctaacggtagtacggaacttaccgtaaccgaaccggtacgttcggtacggtctaccggtacccg

SEQ ID NO: 150620 - DNA, 621 bp, Homo sapiens
  misc_feature: GYAE6OF02HW1D3.33.80.H03.1.454.CMB.1.raw
  modified_base (279)..(279): a, c, t, g, unknown or other
  misc_feature (279)..(279): n is a, c, g, or t
  modified_base (324)..(324): a, c, t, g, unknown or other
  misc_feature (324)..(324): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagggtcaccatcacgttgccggcaagtcagagcataagcaactatttaaattggtatcaacagaaaccagggaaacnccccgtaaggtcctagatctatgactgccgtccagtttcgcaggngccggggtcccagtcgaagttcgagtggactaggtggattcgtaggacctagtatttacctactccgtaccaaccctataccagacctaagtccgtagaccgtaacggttacgaagttacgttttagaccttaacctttaaccttacttacggtaccaaacgtagtaacgttaccgaaccaaaccgaaccccttacgtttacctacgttttcccggacccgttaccgggaacccttacgaaggttacggacttacggtacccgtaaccgaaccgttacggtacgtccgtagaacccg

SEQ ID NO: 150621 - DNA, 685 bp, Homo sapiens
  misc_feature: GYAE6OF02I7G1U.33.80.H03.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatcctcctgtctgctatctgtaggagacgagggtcacatcacttcggccggganaagtcagagcataanctaacttaatttaaattggtaatacaaacaagaaaccgaagggaactaccccgtaaggtcctagatctatgctgcgtactagttcgcgaggacggccgggtacccagtacgtaacggttcaggtcggtagtaggtcggtacgtcgtagggactagtactttcacgtcctacgactactcgacgtactacgtctacgtaccgtaaggttaagtaacgtttacgttttacgaacctttaaacttaccttaaccgttaagtaaccgtaaacgacggtaacgtaccaaaccctaaacccgtaccccttaacgtttacccgttaaccgtttcccgggaaccccgttaccgggtaaacccgtaccgtaacgggttaccggtaaccgttaccggtaacccgtaacccggttaacggttaccgggtacggtaccttaccggtaacccg

SEQ ID NO: 150622 - DNA, 811 bp, Homo sapiens
  misc_feature: GYAE6OF02J1XUA.33.80.H03.1.454.CMB.1.raw
  modified_base (212)..(212): a, c, t, g, unknown or other
  misc_feature (212)..(212): n is a, c, g, or t
tcagtacacacactcacgaccggtgctcgatttagctgtgcgtcgaagggaaaggggcgaggagtcagtctcagtcaggacacagcatggacatgacgggtccccgctcagctcctggggctcctgctactctcggctccgaggtgccagatgtgacatccagatgacccagtctccatccctcctgtcctgacatctggtaggagaaccgnggggtcccaccgatcccgtacgtttcgggacccggggacctaaaggtaccgaggtaacggaccaacgtaaagacctaaaaccttaacttttaaaagtttacggttaacgttaacctaaaaccgtaacgtaaaaccccggaaacgggtaaaacccggaacccccggttaaacgggttacccttaaggtaacttacctaagttcgtacgtcgtaccgttaccgtacggtttacgacgtaacggacggtaccggggtaccccgtagtaccgtaacggttaccgaggtacggtcgagttaggagttaccggtagggtaccgaagggttctttacgtaccttacctactaccgttaacctaccggtataccgtactccgttacgaccgtaacggtacgttaaggttacgttttaggaaccttaactttaacccgttacgaacgttacccaaacgtacgaaccttaacccgaaacctaacccgtaacccctattaacccttaccgtttcccgacccggttaccgggaaccgtaaccgtacggttaaccgtacgttaaccggtaccctaaaccggtacgtaccgggtacgtaccgttacgaacccg

SEQ ID NO: 150623 - DNA, 513 bp, Homo sapiens
  misc_feature: GYAE6OF02HCNB2.33.80.H03.1.454.CMB.1.raw
  modified_base (200)..(200): a, c, t, g, unknown or other
  misc_feature (200)..(200): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccaccctcctgtctgcatctgtcgganacagagtcaccatctcttgccggcaagtcagagcatcgtccgctatttaaatgtatcagcagaaaccagggacaagcccctaaactcctagatctatgctgcgtccagtctgcaaagtgggtccatcgaagttcagtgcagtgatcgtgggacngtatttcactctcacatcagctagtctnacctaacgtnaagttactttagacctaacttacttcttgtactaactactattaacactacctaccgtactcgttttacggaccgtaagggacctaacgcgtaggagtactacgagacgactggtagtacg

SEQ ID NO: 150624 - DNA, 727 bp, Homo sapiens
  misc_feature: GYAE6OF02I8D86.33.80.H03.1.454.CMB.1.raw
  modified_base (116)..(116): a, c, t, g, unknown or other
  misc_feature (116)..(116): n is a, c, g, or t
tcagtacacacactcacgaccggtgctcgatttagctgtgcgtcgtaaggggtaaagggggggcaggagtcagtctcagtcagggacacacgcatggacagtgacggtcccgctcncgctcctggggctcctgcgtgctcgtcggcctcccaggtcgccagatcgtgacactcagtactcgaccctgtcctccactcctcctgtctgacttctgtcggagacagacgtaccacatcacgttcgacctaggactagtgacgtactagttaacggtaaatttttaaacgttcggttacaacgaccaaagtaaaccgaggtaaaccgtaccctagactaccgtagtacgttacgacgtacgctaacgtaccgtaacttacggaaacgttacgggtaccctagggtaacggtcgtaacgtgggagtggaacgtcgtacgggactacgttacctttacccacgtactactcgacgacacggtcctagaccaggtcctaggaacgtcttacgtacgacctaagtacttaagtacgttacgtaactaacgttaaacttaaacttaaaacgttactaccggttacccggtttaaccgttacggttttacccggggacccggtaaacgggggtaacctagggtacccgttaacggtaaccggtacaaacgttaaaccggtaacggcgttaccgggtacctacggtaccacccggtttacgttccgtaacgttcccg

SEQ ID NO: 150625 - DNA, 690 bp, Homo sapiens
  misc_feature: GYAE6OF02H491K.33.80.H03.1.454.CMB.1.raw
  modified_base (169)..(169): a, c, t, g, unknown or other
  misc_feature (169)..(169): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccngtctccatcctcctgtctgcatctgtaggagacgagggtccaccatcacttcggccgggacaagtcaagagcataagactaactatttaaattggtatacaanagaaaccgagggaaacncccctaaaggtcctagatactatagctagcgttccagtttgctaggaggccggggtacccagtccgtaaggttcaggttggacgtaggtggactcgngggacaggtactttccgactcctaccacctatcgtaagctaacgtcgtcggaacctaaaggtacgtaaagttacttttaggaccttaaaccttttaaccgtaacttcggtaacctaaaacgtacgtaaaccgttaccaaaccgtaaacccctaaaccccttaatttaaccccttaacccgtttttaccccgggaccccgttaccgggggtaaaccctaacccggttacgggtaacggttaccggttaaccgttacccgaaaaccccggttaccgttacgggtacggtaccgtaccggtaacccc

SEQ ID NO: 150626 - DNA, 617 bp, Homo sapiens
  misc_feature: GYAE6OF02GN166.33.80.H03.1.454.CMB.1.raw
  modified_base (227)..(227): a, c, t, g, unknown or other
  misc_feature (227)..(227): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtcctccactcctccctgtctgcatctgtaggagacagatccaccatctcttgccggnaagtcagagcatcgtccgcttaatttaattggtatcagcaagaaaccgaggcaacgccccgtaaggcctgatctatcgctgcgttccagttcgcgagaggtccgggtacccagtacgtaacggttcaggtcggactaggtaggacgtacgtgggtaacagtactttacaaccttctaccacctactacgagctacgtcttagactaacgtagtaagttattttacgaacttaaacgttacttacgttagtacctaaacgacgtaagtaccaaaccgtaacccaacccctacttaccgtaacccgtttacccggtaccccgtaaccgggtaacccctaaccggtaggttacggtacgtaccggtaacctaacccgtacggttaggtaccgg

SEQ ID NO: 150627 - DNA, 818 bp, Homo sapiens
  misc_feature: GYAE6OF02HZPSG.33.80.H03.1.454.CMB.1.raw
tcagtacacacactcacgaccggtgctcgatttagctgtgcgtcgaagggaaagggggcaggagtcagtctcagtcaggacacagcatggacatgaggtccccgctcagctcctggggctcctgctactctggctccgaggtgccagatgtgacatccagatcgacccagtcctccacttccctcctacgtcctaagcctatcctgtacggaacgacgtacgggtaccaccagtcctaccgttggacccgggacaaacgttcgaaggacgcctaagtaacgactaacttaatttaaacgtggttaactaccaacgtaaacgaaaccgtaagggaaaccgtaaccccctaaggtacccttaggtaactagttacgtacgtacgtccgtaccgttacctaggttttacgaccgaggtaccgggtccgggttaaccacgttacgtaaccgggttacgacgggttcgtaaccgagggttcgtacgttgtacggggaccttaaggtactttacctaaccgttccgtaccgtaaaccgtacctacggtaacgtccgtaaccgttacgtaccggtaaccgtaacccggtaaggttaaacgttacgttttaaccggtaacctttaaaccgttaccgttttacgtaaccgtttaaaccggaacccttaaaccggtacctttaaaccgttaaccgtttacccgttaaaccgttaccgttaccgtttacccggaccgggtaaccggtacccgtacgttaacggtcgggtaactacggtaacgaccggtaccgtaaccgttcgggtttaacgtccgttagggttaacccc

SEQ ID NO: 150628 - DNA, 597 bp, Homo sapiens
  misc_feature: GYAE6OF02JDLNM.33.80.H03.1.454.CMB.1.raw
  modified_base (207)..(207): a, c, t, g, unknown or other
  misc_feature (207)..(207): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatcgacccagtctccatcctccctgtcttcatctgtaggagacagngtcaccatcacttgccggacaaggtgagagcattaacgaaccttatttagaattggtatcgagctagacgaccgaagggaaaccgacccccaaactcctagactctctacgccgcactccgtactttacactaacgtcgggtacccagtaccgaggttcagtcggactaggtgatcgtcggacagttattcactctaccaactagaagcacgtctacggtacctagtaacgtagtttaggaacttacttacttcgtacgtaactaactacgttaacttaagttaaccgttaacccgttaacttacggttttacggaccgtacggggacctaacggtacgtacggagtactacgaacgtacgtaacgtgtacgtcgtacgaccaccgtacg

SEQ ID NO: 150629 - DNA, 676 bp, Homo sapiens
  misc_feature: GYAE6OF02IX3XR.33.80.H03.1.454.CMB.1.raw
  modified_base (201)..(201): a, c, t, g, unknown or other
  misc_feature (201)..(201): n is a, c, g, or t
  modified_base (667)..(667): a, c, t, g, unknown or other
  misc_feature (667)..(667): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacgtccagatgacccagtctccatccctcctgtcttcatctgtagganacagagtccaccatcacttggccggacaagtgagagctattaacgaacttatttagtaagttggtactcgagcaagacgaaccgaagggaaaccaccccctaaactccgtacgacttcctacgtcgacccgtactaccgttacccgttattaaccaacgtaaggtccgggtacctagtacgtacggttcagggttcgagtaggtagtacgtcggtaggacgtagtactttacgtacctcctaccactactcgtaacgacgtattccgtacgaaccgtaaccgttagtaaccgttacgtttacgacctttaacctttacgttacgttacgttaacctaaccttacgtaacgttaacctaaacgttacccttacccgttaaacgttcggtttaccggacgtaaccgggtaacccgagttacgtacggaactacgtaacggtaacggtcggtaaacgtcgtacggtacncggtaaccc

SEQ ID NO: 150630 - DNA, 776 bp, Homo sapiens
  misc_feature: GYAE6OF02IDP7U.33.80.H03.1.454.CMB.1.raw
  modified_base (106)..(106): a, c, t, g, unknown or other
  misc_feature (106)..(106): n is a, c, g, or t
tcagtacacacactcacgaccggtgctcgatttagctgtgcgtcgaagggaaagggggcaggagtcagtctcagtcaggacacagcatggacatgagggtccccgntcagctcctggggctcctgctactctggctccgaggtgccagatgtgacatccagatgacccagtctccatcctcctgtctgcatctgtagagacagggtcaccatctctgccggcaagtcagagcatcgtccgcttaatttaaattggatcagacaagaaaccagggacaacgtaccccgtaaaactcctagatactatgctacgcgttccgtagtttcgcgaaggaacggtccggggtaccctaagtaccgtaaaggtttcaaggttcgggactagtaggtagttttggggacctaggtacttttacgacctttccgtcccgtaccgtacccaccgtaacgtcccgttacggaccgtagggtccttaaagggtaaagtttcgttttttaccggaaacctttaaaccttttaaacgttttaaccgttaacggttaaaaccttaaaaaggttacgttacggaaaccgttacgggttacccgggtacccccgttactttacccggttaacccgtttttacccggggaccccccggtttaaagggggaaaacccccgttaaaaacgggttaaacggggtaaaaacccttaaaccccgtaaaaaccgggtttacccgtttaacggggttaccgggtacccgtttaacgggtacccctaaaccccgttaaccgg

SEQ ID NO: 150631 - DNA, 774 bp, Homo sapiens
  misc_feature: GYAE6OF02GXTVE.33.80.H03.1.454.CMB.1.raw
  modified_base (230)..(230): a, c, t, g, unknown or other
  misc_feature (230)..(230): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtagagacgagggtcacatcacgttgaccggganaagtcagagacaagtaagactaactaatttaaaattggttaactactaaacaacggaaaaccgaagggtaaaaccgacccccgtaaacggttaccttacggtaacttacgtaatcgtacgtcgtaccgtccgtagttttacgacgaggtaacggcccggggttacccaaggtaacctaacgggtttacgaacgggttacggacggtaacgggttacggtaacgttaccggtacgggtaaaccgtagtttaacgttttcctaaccgttacctaccctaaactaacttacgacgtactacggtacctaggaccgtaaacgtaggtaaacgtttaacttttacggaacttaaacctttaacttaacgtacgtaacccgaaagtacggtaacgttaaccgaacctaaaccccaccccttaactttacccgttaacccgttttcccgggacccccgttacgggaaccccgtaaacggtacgttaacggtaccgttaacgtaacccgaaacccggttaaccgacgggtacggttacctaccggtaacccc

SEQ ID NO: 150632 - DNA, 318 bp, Homo sapiens
  misc_feature: GYAE6OF02GR36V.33.80.H03.1.454.CMB.1.raw
  modified_base (238)..(238): a, c, t, g, unknown or other
  misc_feature (238)..(238): n is a, c, g, or t
  modified_base (283)..(318): a, c, t, g, unknown or other
  misc_feature (283)..(318): n is a, c, g, or t
tcagtacacacactcacgaccggtgctcgatttagctgtgcgtcgaagggaaagggggcaggagtcagtctcagtcaggacacagcatggacatgagggtccccgcgtcagctcctggggctcctgctactctggctccgaggtgccagatgtgacatccagatgacccagtctccatcctccctgtctgcatctagtagagacaggtccacatcacttggccggcaagtcagagcanaagacaactatttaaagtggtatacaacacgtaaacaaacgggtnnnnnnnnnnnnnnnnnnnnnnnnnnnnnnnnnnnn

SEQ ID NO: 150633 - DNA, 560 bp, Homo sapiens
  misc_feature: GYAE6OF02HSL8C.33.80.H03.1.454.CMB.1.raw
  modified_base (257)..(257): a, c, t, g, unknown or other
  misc_feature (257)..(257): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (528)..(528): a, c, t, g, unknown or other
  misc_feature (528)..(528): n is a, c, g, or t
tcagtacacacactcacgaccggtgctcgatttagctgtgcgtcgaagggaaaggggcaggagtcagtctcagtcaggacacagcatggacatgagggtccccgctcagctcctgggctcctgctactctggctccgaggtgccagatgtgacatccagatgacccagtctcatcctcctgtctgcatctgtaggagacagggtccaccatcacttgccggcaagtcagagcatagcaactatttaaatgtatcaanagaaacaggaaagcccctaaaggtcctgactcgtactgcctgcgtccagttttgacagacggcggggtcccattcgaaaggttcaagttggcgtagtgggattcgaggggacaaggtnttttccaatccgtacaacccgntaccgtagacctaagtcttaggaccgtaaacgttggtaaagtactttttcggaactaacgtttactaaccgtgttactaaacgagagttacacaaaccgaccctaattcactttcgaccctggaccactgngactcgtacgaaccgtatggtacggactgacc

SEQ ID NO: 150634 - DNA, 782 bp, Homo sapiens
  misc_feature: GYAE6OF02FSFTU.33.80.H03.1.454.CMB.1.raw
  modified_base (106)..(106): a, c, t, g, unknown or other
  misc_feature (106)..(106): n is a, c, g, or t
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
tcagtacacacactcacgaccggtgctcgatttagctgtgcgtcgaagggaaagggggcaggagtcagtctcagtcaggacacagcatggacatgagggtccccgntcagctcctggggctcctgctactctggctccgaggtgccagatgtgacatccagatgacccagtctccatcctcctgtctgcatctagtaggagacnggtcaccatcacttggccgganaacgtcagacgcaagtaacgacaacttaattttaaaagtttggttaataccaaacgaagtaaaacccgaaggggaaacgtaaccccccgtaaggtaccgttacggtactacttacgtcggtacgtgtaccgtaccgtagttttacggccgtaaggaccggtccgggggtaccccaagttcggtaaacggttccgtaaggttcggacgtaacgggtaggtactacggtagggtaacgagttaacgttctaacctcgtaccacgtaactacgacgtcgtacgttccgtacgacctaaccggttacgtaacgttacgttttaccgaaccggtttaaccttttaaccgtttacgttaccgttaaccgtaaaccgttaacctaaacggtttaaccctaaactttacccccggttaaccccgttaacccgtttaccgttttaccgggaccccgggttaacggggtaaccccgtaagggttaccgtaacgggtaaccgtaacggtttaaaccgaaaccggttacggttaccgggtaaccggtctaccgggaaccttaacccgg

SEQ ID NO: 150635 - DNA, 550 bp, Homo sapiens
  misc_feature: GYAE6OF02FX9I9.33.80.H03.1.454.CMB.1.raw
  modified_base (301)..(301): a, c, t, g, unknown or other
  misc_feature (301)..(301): n is a, c, g, or t
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaacgcccccaaactcctagatctcngccgacatccgattacacaagtcgggtccagtcgtagttcagtgcagtgatcgtggacagtactttcgactctacacatagcatcgtagacctagaagtagtttagaatatacttctagtccaagtagtacttagtaacgttaacccgtacttacgttttacgcgtaacgggtaccaagtacgtagggtaacgtacgtacgaaagtccgaacgttggtacggtctaccggtacgacctacgtcttaccg

SEQ ID NO: 150636 - DNA, 766 bp, Homo sapiens
  misc_feature: GYAE6OF02GK9TB.33.80.H03.1.454.CMB.1.raw
  modified_base (108)..(108): a, c, t, g, unknown or other
  misc_feature (108)..(108): n is a, c, g, or t
tcagtacacacactcacgaccggtgctcgatttagctgtgcgtcgaagggaaagggggcaggagtcagtctcagtcaggacacagcatggacatggacgggtccccgntcagcctccgtggggcctcctgctactctggctccgaggtcgccagatgtgacatccagatcgacccagtcctaccactccctccctgtctgacattctgtaggagacggtacggtaccaactcgtacctacgttcggacccgggactaacgtcaacggacgtacaagtaacgaccttaaatttaaagttttaaagttcggtaactaaccgaaaacgtaaaccgaaaaccggtaacgggtaaacccgtacccgttaacggtcctagtactacgtgtcgtctcggcgttaccgttgttacgacgtaggtccggtaccggttaccaagttacgtaaggtcgtaggtcgagacggtggtagtccgtaggactacgtttacttcctactacccgtacaccgtacgtaccgacgtacgtacctcgaccgtaacgtaagttaacgtaaattttaccggtttacctaaccttaaccgtttaaactccgttaacaaaccgacgtaaacgtacccgttaaccaaacccgtaaccctaaccctttacgtcccgtttaaccgttaccccggtaacccggtaacccggtaacgtaaccggttacgggtaacgtacccgttaacggaacccgttaaccggtaggttaacgggtccgttaccgacgtaaccc

SEQ ID NO: 150637 - DNA, 666 bp, Homo sapiens
  misc_feature: GYAE6OF02G6W3G.33.80.H03.1.454.CMB.1.raw
  modified_base (209)..(209): a, c, t, g, unknown or other
  misc_feature (209)..(209): n is a, c, g, or t
  modified_base (641)..(641): a, c, t, g, unknown or other
  misc_feature (641)..(641): n is a, c, g, or t
tcagtacacacactcacgaccggtgctcgatttagctgtgcgtcgaagggaaagggggcaggagtcagtctcagtcaggacacagcatggacatgacggtccccgctcagctccgtggggctcctgctactctggcctccgaggtgccagatgtgacactccgagtatcgacccagtcctcccaccctccttgtctgcatcgtgcgganacagtcgtcaccatctctcggaccggacaagtcaggacgcagtccgtccgacttaatttaagttggtactcgacgacacgaaacgacggacaccgacccctaacgtacctgtaactgtactcgtcgcgtacgtcctacgtatacgtaccgtaaacggttcgggtaccctagtacgttaacggttcgaaggtcggacgtagggtacgttaggtacggtacggtaactaacggtttacttcggtaccttacctaccgtaaacccgtagttaaccgtacgtaccgtacggtacgtacgtaccccgtaagttaacgttaagtacgtttttacgaccgttttaaacttccgttacgttacttaccaacgtaaccttaagttacccaaagttccctaaccgttcgttacgttacgaccggtagaaccgataggtaccngtacactagacctagtagtcgtccg

SEQ ID NO: 150638 - DNA, 959 bp, Homo sapiens
  misc_feature: GYAE6OF02FPAAZ.33.80.H03.1.454.CMB.1.raw
  modified_base (195)..(195): a, c, t, g, unknown or other
  misc_feature (195)..(195): n is a, c, g, or t
tcagtacacacactcacgaccggtgctcgatttagctgtgcgtcgaaggggaaagggggcaggagtcagtctcagtcaggacacagcatggacatggacgggtccccgctcagctcctggggctcctgctactctggctccgaggtcgccagatgtcgacatccagactcgaccagtcctccactcctcctgtcngctatcgtaggtaggacgacgtacgggtaccaaccgtactaccgtacgttcgggacccgggactaacggtcacgacgtacaagtaacgtactaaactttaatttaaacgttacggttaactacgaaacgtaacggaaaccggtaacggggaaaccgtaccccggttaaaggttccgtaggtaaccttacgttaacgtcggtccgttaccggtaccgttaccgttaacggtttacgaaccggtacggggtaaccggggttcccgggggttaaccctaacggttaaccgggttaaacgggtttaccggtaacgggggtttacccggtaacgggttaacgggttacggggttaaccgttacggggttaaccggggtaaaccgtttaaacggttttaaccttttacccgtaaccgttaaccctaccggttaaaccctacgttaaccggacgttaaccgtaccggttaccggttaacggtaacccggtttaaacgggttaacgtttaaaggttttaccggtttacgttaaacccttttaaaccggtttaaccttacccggtaaacgttaaacccgtaaacggtaacccggttaaaccgtaaacccgtaaacccgtaaaccccttaacccgttaaccgttaaccccgtttacccgggtttacccgacccggttaaccgggtacccgtaacgtaccggggttaataaccccggttaccgaacccggttaaccggtacgtttccggggtacccttacggacccggtaacccc

SEQ ID NO: 150639 - DNA, 736 bp, Homo sapiens
  misc_feature: GYAE6OF02I7N4B.33.80.H03.1.454.CMB.1.raw
  modified_base (155)..(155): a, c, t, g, unknown or other
  misc_feature (155)..(155): n is a, c, g, or t
tcagtacacacactcacgaccggtgctcgatttagctgtgcgtcgaaaggggaaagggggcaggagtcagtctcagtcaggacacagcatggacatgagggtccccgctcagctccgtggggctcctgctactcgtggctccggaggtcgccagntgtgacatccgagatcgacccagtcctccactcctcctgtctgtcatcgtggtcggaagaccagacgtcacctactccttcgtcggccggactagcgtacgacgctacgtcgtaccgtactttaatttaacgttggtaactcgtaagaccgaaacggaaccgacggacctaacccggtaacccctaagtcccgtagtaacttctagtcgctcggtacctacgtaccgtcgtacggaacgttaacggggtccggtaccaacgttaacggtaggtttacgaggttacgagtaacgggttcgacggttaacggtacggtaacgtacgttaccgtttacgtcctacgtaccgaacctcgtacgtacgacgtacgtacgtacgaccgttaacgtacgttaacgtttcttacccgtaacgtttaacctttaccttacgtacctaactaacgttaaccgtaacgttaacctaccgttaccgtttaccgttaccgggttttaaggaacccgggtaaccgggtaacggttaacctacggttacgaggttaacccgacggttacgtaacggtacggtacggtcgtaaccgg

SEQ ID NO: 150640 - DNA, 1055 bp, Homo sapiens
  misc_feature: GYAE6OF02JTAJL.33.80.H03.1.454.CMB.1.raw
tcagtacacacactcacgaccggtgctcgatttagctgtgcgtcgaagggaaagggggaagaccgatgggtcctcggtgaaggtctcctgcaggcctctggatacatcttcagtgctatactatcaacgtgggtgcgacgacggtccccgtggacaagggcttaggagtggagtgggaggactcactaccctaataaacctacccaacagaaacttccgaggcacgactaccacgtaacgttaccggaccggtaacgaacctacccgacgacgacgtaacgaccgtaccctaacacggttacggaacgtccgtaccgaccgacggtccgtacgtaccgtacttacgacgtaacggaccgtaccggacctaagtttacgttaacgtttagttacggtacgggtaccggtacgtaccggtttaccgtaccgggttaacccgttttaacgttttttccccgggttttttagggttaccggtttaaggttttaaccgtaaaccccgttaccccccgttacggtttcccggtttaccccggtaccccggttccggggaacccgtacccgggttaccccgtttccgggttaccccgtttaaccccggttccccggttaccgtaccccggttaccccgtaacccgtaaccccggttaaacccgggtaccccgttacccgggtttaccccggttttacccccccggtttaccccccgttccccggttacccccgttaaccccccgttaccccgttaaacccggaacccggttaaacccccgttccccggtacccggttttacccggggaacccggggtcccgttaaacccgggtcccgggtaccccgggttcccggttaacccggggcccggtttccgggtaccccgggtttaccggtaacccgggtttaaacccgttacccccgggtttaacgttccccgttaacgggttttcgttaaccgggtttaccggttacccggttaacggtacccgggggttaccggttaccggtaccgggtaacccgggtccggaccggttaaccggtcggttaacgcgggttac

SEQ ID NO: 150641 - DNA, 871 bp, Homo sapiens
  misc_feature: GYAE6OF02FN1QJ.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctccgtggggctcctgctactctggctccgaggtgccagatgtgacatccagatcgacccagtcctccatccctccctgtctgctatctaggtaggagaacgagggtccaacctagtcctaacgttcggccgggactaagtcaagacgacaagtaacgactaaacttaatttaaaacgttggtaataaccgaaacgaacggaaaacccgaaggggtaaaaccgtaccccgttaacggtaccctagtacttactaagtcgccttggtaccgttacgtaggtttcgacgtaacggaccgggtaccgggtaccctaagtaccggtaagggttacgacgggttacgggactaagggtacggtaacgtcgggtacgggtaacgttacggttaactttaccgtaaccttaccgtacccgtaaacctaccgtacggtaaccgtaccggttacgttaccgtaacggtaaccgtaaacggttaggttaaacgtttagttttaaccgaacccgtttaaaccgtttaaccgtaacgttacggtaaacccgtaaccgtaaggttacccgaaacccgttaaaccccgttaaaacccgttaacccccttaaacgtttacccccgttaacccggttttaccccggaaccccgggtttaacccgggtaaacccgttaacccgggttaacgggttaacggtacccggttaacccggtaacccgtaaacccgggttaaaccggttcccgggtacgggtacccgttaccggtaacccccg

SEQ ID NO: 150642 - DNA, 931 bp, Homo sapiens
  misc_feature: GYAE6OF02HZBOV.33.80.H03.1.454.CMB.1.raw
  modified_base (184)..(184): a, c, t, g, unknown or other
  misc_feature (184)..(184): n is a, c, g, or t
tcagtacacacactcacgaccggtgctcgatttagctgtgcgtcgaaagggaaagggggcaggagtcagtctcagtcaggacacagcatggacatgagggtccccgctcagcctccgtggggctcctgctactcgtcggctccgaggtcgaccagtatgtagacactaccaggactcgaacccncgttcctacccgacttccctccgtcgtactgctactcgtaggtaggagaaccgacgggtacctacgatcgtaaccgttcgggaccggtaacaagttcgaacggacaacgtaaacgttaacgaaacttaaaactttaaacgtttttaaaacgtaggttaaaccttaaaccgaaaacggaaacggtaaaaacccggtaaaacgggggaaaacccgttacccccgttaaaacgggtacccgttaacggaacgtttacccgtaaggttccgtaccgttaacgggttcccgttaaccgttaaggttttaccggaaccggtaacgggtaccggggtaaccccggtaacccttaggttaaaccggttaacgggttactaacgggtacgggttactaaacgggtcgtaacggttcgggtaaccgggtaaacgttaacgtttcctttaaccgacgtttaccctaaacccgtaaccttacgtaacgtacggtaaccgttacgtcggtaacggtaaaccggttaaacggttaagtttaaaggttacgtttaaccggttaaacttaaacctttaacgttaacgttaccgtaaacgaagtaaccggtaacttaaaccctaacccgtaaaccctaaacccgttaacgtttaaccgttaacccgggttcctaacccgggtaaccgaacccggtacgtaacggttaacgttacgtaaccgttaaccgtaaccggttacgtaacggtcgtacgtcctaaaccgg

SEQ ID NO: 150643 - DNA, 949 bp, Homo sapiens
  misc_feature: GYAE6OF02GYP6Z.33.80.H03.1.454.CMB.1.raw
tcagtacacacactcacgaccggtgctcgatttagctgtgcgtcgaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgagagacaggtacaccatcacttcggccggtacaagtcagagaccaagtaacgacgtaaacttaattttaaaacgttcggttaacttaccgaaacgtaaacggtaaaaacccgaacggggtaaaaccgtaacccccgttaaacgggttacccgttaagaacgtttaccgtaagttcggtaccgttaggaccgtttaccggtaggttttacgacggaacgggtaaccgggtccggggtacccaagttacggtaacgggtttaccgaagggttcggacggttaagggttacggggtaactttaccggggtaacggggtaaactaacggtttacccgtttaaccgtaccgtttaacccgttacctaaaccccgtaagttacccgtaacggtaaccgttaccgttaacggttacccgtaaccggtaaaaccgggtttaacgtaaaaccggttttacgttttaacgggttaaacccttaaccgtttaaacccgttaaccggtttaacgtaaacccggttaaaaccgtaaccgttaaaaccgtttacccgaaaacccgtttaaaccccggtaaacccccttaaccgttttaaccccgttaacccgggtttttacccccgggaccccggtttacccgggtaaacccgggttaacccggttaaacggggtttacgggttaaacccggtttagttaaaacccccgggtaaccggttaaacccggtttcggggtaacccggtttacccgtacccgggttaaccccg

SEQ ID NO: 150644 - DNA, 493 bp, Homo sapiens
  misc_feature: GYAE6OF01BMYSH.7.5.A05.1.454.CMB.1.raw
tcagcgtgtctctacacgaccggtgctcgatttagatagatagacagggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctgggctccaggctgaagacgaggctgattattactgcagctcatatacagcagcagcactcaggttttcggcggagggaccagctgaccgtctaggtcacgccaggctcgcccctggtcc

SEQ ID NO: 150645 - DNA, 500 bp, Homo sapiens
  misc_feature: GYAE6OF01AKEW3.7.5.A05.1.454.CMB.1.raw
  modified_base (487)..(487): a, c, t, g, unknown or other
  misc_feature (487)..(487): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctggctccaggctgaagacgaggctggattattactgcagctcatatacaggcagcagcactcaggttttcggcggagggaccaaggctgaccgtcaggtcacgcccaaggcncgcccctcggtcc

SEQ ID NO: 150646 - DNA, 506 bp, Homo sapiens
  misc_feature: GYAE6OF01CT9HM.7.5.A05.1.454.CMB.1.raw
tcagcgtgtctctacacgaccggtgctcgatttagatagatagacagggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccaggcaaagcccccaaagtcatcatttatgatgtctataatcggccttcagggtttccaatcgcttctctggctcaagtctggcgacacggcctccctgaccatctctggctccaggctgaagacgaggctgattattactgcagctcatatacaggcagcagcactcgtaggtttcggcggtacgggaccaaggtctagaccgtcgtaggtcacgcccaacggctccgccccgtcggtcc

SEQ ID NO: 150647 - DNA, 501 bp, Homo sapiens
  misc_feature: GYAE6OF01AR2EI.7.5.A05.1.454.CMB.1.raw
tcagcgtgtctctacacgaccggtgctcgatttagatagatagacagggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcaggttttcggcggtaggaccaagcgtgaccgtcctaggtcagcccaaggctcgccccgtcggtcc

SEQ ID NO: 150648 - DNA, 493 bp, Homo sapiens
  misc_feature: GYAE6OF01CE0LB.7.5.A05.1.454.CMB.1.raw
tcagcgtgtctctacacgaccggtgctcgatttagatagatagacaggggtctcaggaggcagcactctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataaatcggccttcagggtttccaatcgcttctctggctcaagtctggcgacacggcctccctgaccatctctgggctccaggctgaagacgaggctgattattactgcagctcatatacaggcagcagcactcagtttcggcgagggaccaagctgaccgtctaggtcagcccaagctcgccccgtggtcc

SEQ ID NO: 150649 - DNA, 526 bp, Homo sapiens
  misc_feature: GYAE6OF01B6YDP.7.5.A05.1.454.CMB.1.raw
  modified_base (245)..(245): a, c, t, g, unknown or other
  misc_feature (245)..(245): n is a, c, g, or t
  modified_base (387)..(387): a, c, t, g, unknown or other
  misc_feature (387)..(387): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggacaaagcccccaaagtcatcatttatgatgtctataatcggtccttcgagggtttccaatcgcttctctgctcaagtctgcgacacggcctcctgaccactctcgtcggctccgnggctgaagacgaggctgattattactgcagctcatatacagcagtcagctactcgtacggttttcggacggacgggaccaaggctacggaccgttccgtaggtccaacgtcccgaaggcctcgcccccgttggtacccg

SEQ ID NO: 150650 - DNA, 529 bp, Homo sapiens
  misc_feature: GYAE6OF01ATM5R.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgcttcagggtttccaatcgcttctctggctcaagtctggcgacacggcctccctgaccatcctcgtcgggctccgaggctagaagacgaggctagattattactgcagctcatatacaggcagcagcactcgtagggtttcggacgggacggaccgaaggtcctaggacccggtccgtaggtccacgtacccgaaggccctcggcccccgtcggtaccc

SEQ ID NO: 150651 - DNA, 553 bp, Homo sapiens
  misc_feature: GYAE6OF01C8MZJ.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctggggtctcctggacagtcgatcaccatctcctgcactggaaccacactgacgttgccttggttataaatatctctcctggtatcaacaatacccaggcaaagcccccaaagtcatcatttatgatgtctataatcggcctttcaggggtttccaatcgcttctctggctcaagtctggcgacacggcctccctgaccatctctgggctccgaggctagaagacgaggctgattattactgcagctcatatacagcagcagcactcgtagggttttcgggacggtacgggaccgaacgtcgtacgtacccggtccgttacgggttccgaacggtaccccgaaacggccgttcccgccccccgttcgggttacccg

SEQ ID NO: 150652 - DNA, 507 bp, Homo sapiens
  misc_feature: GYAE6OF01EINR3.7.5.A05.1.454.CMB.1.raw
  modified_base (453)..(453): a, c, t, g, unknown or other
  misc_feature (453)..(453): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctcgggctccaggctgaagacgaggctgatttatactgcagctcatatacaggcagcagcactcgtaggtttcgggnggacgggaccaagctgaccgtcctaggtcacgccaaggcctcgcccctcggtcc

SEQ ID NO: 150653 - DNA, 567 bp, Homo sapiens
  misc_feature: GYAE6OF01C6OIR.7.5.A05.1.454.CMB.1.raw
tcagcgtgtctctacacgaccggtgctcgatttagatagatagacaggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatatctctcctggtatcaacaataccaggcaaagccccaaagtcatcatttatgatgtctataatcgccttcagggttcaatcgcttctctggctcaagtctggcacacggcctcctgaccatctctggctcacggctgaagtacgacggctgattattactgtcagtctcgattaactacgaggactaggacctaaggcaaccgtcgtaacgggttttccgggaccgggtaacgggaacccgaaacggtccgtaggaaccccggttccgttaacgggtccgaacggtaccccgaaggacccgttccgtccccccgtcgggtacccc

SEQ ID NO: 150654 - DNA, 514 bp, Homo sapiens
  misc_feature: GYAE6OF01CG9LG.7.5.A05.1.454.CMB.1.raw
  modified_base (316)..(316): a, c, t, g, unknown or other
  misc_feature (316)..(316): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttnagggtttcaatcgcttctctggctccaagtctggcgacacggcctccctgaccctatctctgggcctccgaggctgaagacgaggctgattattactgcagctacatatacaggcagcagacactctaggtttcggcggagggaccaaggcgtgacccggtctacggtcagacccaaggcctcgccccgtcggtaccg

SEQ ID NO: 150655 - DNA, 507 bp, Homo sapiens
  misc_feature: GYAE6OF01DZ1WE.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctgggctccaggctgaagacgaggctgattattactgcagctcatataacaggcagcagcactctaggttttcggcggtagggaccaaggctgaccgtcctacggtcacgcccaaggctcgccccgtcggtcc

SEQ ID NO: 150656 - DNA, 502 bp, Homo sapiens
  misc_feature: GYAE6OF01EA0GH.7.5.A05.1.454.CMB.1.raw
  modified_base (409)..(409): a, c, t, g, unknown or other
  misc_feature (409)..(409): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggtccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctggctccaggctgaagacgaggctgattattacngcagctcatatacaggcagcagcactcaggtttcggcggagggaccaagctgaccgtccgtagtcacgcccaaggcctcgccccgtggtaccc

SEQ ID NO: 150657 - DNA, 497 bp, Homo sapiens
  misc_feature: GYAE6OF01E3286.7.5.A05.1.454.CMB.1.raw
  modified_base (483)..(483): a, c, t, g, unknown or other
  misc_feature (483)..(483): n is a, c, g, or t
tcagcgtgtctctacacgaccggtgctcgatttagatagatagacagggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctggctccaggctgaagacgaggctgattattactgcagctcatatacagcagcagcactcaggtttcggcggagggaccaagctgaccgtctaggtcacgcccaaggcncgccccgtcggtcc

SEQ ID NO: 150658 - DNA, 495 bp, Homo sapiens
  misc_feature: GYAE6OF01C5O0F.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctgtatcaacaatacccaggcaaagccccaaagtcatcatttatgatgtctataatcggccttcagggtttccaatcgcttctctggctcaagtctgcgacacggcctccctgaccatctctggctccagctgaagacgaggctagattattactgcagctcatatacaggcagcagcactcgaggtttcggacggaggaccaagctgaccgtcctagtcacgcccaaggctcgcccctcggtcc

SEQ ID NO: 150659 - DNA, 504 bp, Homo sapiens
  misc_feature: GYAE6OF01B9432.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccaggcaaagcccccaaagtcatcatttatgatgtctataatcggccttcagggtttccaatcgcttctctggctccaagtctggcgacacggcctccctgaccatctctggctccaggctgaagacgaggctgattattactgcagctcatatacagcagtcagcactcaggtttcggcggaggaccagctgaccgttccgaggtcacgcccaaggcctcgcccccgtcggtacccg

SEQ ID NO: 150660 - DNA, 505 bp, Homo sapiens
  misc_feature: GYAE6OF01B2L3P.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctggctccaggctgaagacgaggctgattattactgcagctcatatacaggcagcagcactctaggtttcggcggagggaccaagctagaccgtccgtaggtcacgcccaaggctcgcccccgtcggtccc

SEQ ID NO: 150661 - DNA, 494 bp, Homo sapiens
  misc_feature: GYAE6OF01DEWEA.7.5.A05.1.454.CMB.1.raw
  modified_base (296)..(296): a, c, t, g, unknown or other
  misc_feature (296)..(296): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttangatgtctataatcggcctttcagggttccaatcgcttctctggctcaagtctggcgacacggcctcctgaccatctctcgggctccaggctagaagacgaggctgattattactgcagctcatatacgagcagcagcactcaggttttcggcggaggacaagctgacgtctagtcacgcccaggctcgcccgtcgtcg

SEQ ID NO: 150662 - DNA, 556 bp, Homo sapiens
  misc_feature: GYAE6OF01CYCGP.7.5.A05.1.454.CMB.1.raw
  modified_base (427)..(427): a, c, t, g, unknown or other
  misc_feature (427)..(427): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccacactgacgttgctggttaataatatctctcctggtatcaacaatacccaggaccaaacgcccccaaagtcactactatttatgatgtctaataactcgtccttcgtagggtttccaatcgcttctctgctcaagtctggcacacgtcctccgtgaccatctcgtcggctccgaggtctaggaacgacgaggtctagattacttacgngcagtctacatactacgaggcagcacgctactcgtacgggtttcggacgggacggaccaggtcgtacggtaccggtcgtacgggtccacggtacccgtaacggtccctcccggtccccgtcgggtaccc

SEQ ID NO: 150663 - DNA, 580 bp, Homo sapiens
  misc_feature: GYAE6OF01DDYUN.7.5.A05.1.454.CMB.1.raw
  modified_base (243)..(243): a, c, t, g, unknown or other
  misc_feature (243)..(243): n is a, c, g, or t
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacatgacgttgctggtataaatntctctctgtatcaacaataccaggacaaacgccccaaagtcatcatttatgatgtactataactcggtccttcgacgggtttccaatcgtcttctcgtggctccaagtctggcgacgacggcctccctgacctactctacgtcgggacctcgacggtctaggaacgtacggacggtctaggtattacgttacgtgctagtcctatactaacgttacaacggtcagacaacgctaacgtacgtagggtttccgggacgggaacgggacctaaggccgtaggacccggtcgtacggtccgacgtccccgaagtcccgtccgtcccccgtcggttacccg

SEQ ID NO: 150664 - DNA, 519 bp, Homo sapiens
  misc_feature: GYAE6OF01B1IOR.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggccttcagggtttccaatcgcttctctggctcaagtctggcgacacggcctccctgaccatctctgggctccaggctgaagacgaggctgattattactgcagctacataatacaggcagcagcactcaggttttccggacggagggaaccaaggctacggacccgtccgtaggtccagcccaaggacctccgccccgtcggtacccg

SEQ ID NO: 150665 - DNA, 533 bp, Homo sapiens
  misc_feature: GYAE6OF01CJ4D0.7.5.A05.1.454.CMB.1.raw
  modified_base (298)..(298): a, c, t, g, unknown or other
  misc_feature (298)..(298): n is a, c, g, or t
tcagcgtgtctctacacgaccggtgctcgatttagatagatagacagggggggtctcaggaggcagacgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggcctttcagggtttcaatcgcttctctggctccaagtctggcgacacggcctcctgaccatctctggctccaggctgaagacgaggctgattattactgcagctcaatatacaggcagcagcacgtcgtagggttttcggacgggacgggaccaaggccgtaggacccggttcctacgggtccgacgcccgaaggtccctccggccccccgtcggtacccg

SEQ ID NO: 150666 - DNA, 514 bp, Homo sapiens
  misc_feature: GYAE6OF01BQSVJ.7.5.A05.1.454.CMB.1.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaacgcccccaaagtcatcatttatgatgtactataatcgccttcagggtttcaatcgcttctctgctcagtctgcgacacgcctccctgaccatctcgtcggctccgagctagaagacgagctgatttatacgtgcagctanatanacgagcagcagcactcgtaggtttcggacggaggaaccagacgtcgaccgtcgtaagtccgacgtaccgacggactccgccccgtcggtacccg

SEQ ID NO: 150667 - DNA, 515 bp, Homo sapiens
  misc_feature: GYAE6OF01ECH9X.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcgtaggtttcggcgggagggaccaaggtctagacccgtcgtaggtccacgcccgaaggcctcgcccccgtggtaccc

SEQ ID NO: 150668 - DNA, 518 bp, Homo sapiens
  misc_feature: GYAE6OF01CT5FI.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatatctctcctgtatcaacaatacccaggcaaagcccccaaagtcatcatttatgatgtctataatcggtccttcgagggtttccaatcgcttctctggctcaagtctgcgacacgcctccctgaccagtctcgtcgggcctccaggctagaagacgaggctgattatactgcagctcatatacagacagcagctactcgtaggtttcggacggtagggaccaaggctaggaccgtcgtacggtcacgtcccaaggcctcgccccgttcggtaccc

SEQ ID NO: 150669 - DNA, 535 bp, Homo sapiens
  misc_feature: GYAE6OF01DUN5F.7.5.A05.1.454.CMB.1.raw
  modified_base (430)..(430): a, c, t, g, unknown or other
  misc_feature (430)..(430): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactggaaccaccactgacgttgcttggttaataatatctctcctgtatcaacaatacccaggcaaacgccccaaagtcatcatttatgtatgtctataatcgtcttcgtacgggtttcaatcgcttctctggctcaagtctggcgacacggcctccctgacctatctctgacgctccgaggctgaagacgaggtctagtatttattactgctagctanatatacaggcagcagactactcgtacggtttcggcggaacggacgacgtcgtacggtccgtacgtagtccgacgtacccgaagcccgtacccgccccgttaccgg

SEQ ID NO: 150670 - DNA, 506 bp, Homo sapiens
  misc_feature: GYAE6OF01AYDPQ.7.5.A05.1.454.CMB.1.raw
  modified_base (413)..(413): a, c, t, g, unknown or other
  misc_feature (413)..(413): n is a, c, g, or t
  modified_base (491)..(491): a, c, t, g, unknown or other
  misc_feature (491)..(491): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaagccccaaagtcatcatttatgatgtctataatcggccttcagggtttccaatcgcttctctgctcaagtctggcgacacggccctcctgaccatctctggctccaggctgaagacgaggctgattattactgcagctnatatacaggcagcagccactcgtaggtttcggcggtaggaccgaagcgtgaccgtccgtaggtcgacgcccgaggccncgccccgtcggtccg

SEQ ID NO: 150671 - DNA, 523 bp, Homo sapiens
  misc_feature: GYAE6OF01CHPBI.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggcttcagggtttccaatcgcttctctggctcaagtctggcgacacggcctccctgaccatctctgggctccgaggctagaagacgaggctgattattactgcagctcatatacgaggtcagcagcactcgtaggtttcggcggtacgggaccaaggtctacgaccggtccgtaggtcaacgtcccgaaggtcctccgcccccgtgggtacccc

SEQ ID NO: 150672 - DNA, 516 bp, Homo sapiens
  misc_feature: GYAE6OF01BZU55.7.5.A05.1.454.CMB.1.raw
  modified_base (409)..(409): a, c, t, g, unknown or other
  misc_feature (409)..(409): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctgctcaagtctggcgacacgcctccctgaccatctctgggctccagctgaagacgaggctgattattacngcagctcatatacagcagcagcactctagggtttcggcggacggaccaaggctagacccggttccgtaggtcacggcccaacggcctccgtcccccgtcggtacccg

SEQ ID NO: 150673 - DNA, 759 bp, Homo sapiens
  misc_feature: GYAE6OF01B26BE.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctaggttataaatatctctcctgtatcaacaatacccaggacaaacgcccccaaagtcatctatttatgatgtctaataatcggtccttacgtacgggtttaccaatcgtacttctctcggctaccaagtcgtcggacgacgacggtccctcccgtacgaccctacttcctcgtcgggtcctccgacggtcgtaggaaacggacggaggtaccgttagtaacttttaacgtttaccgtacggtaccgtaacggtcccttacgtaaatttaacgtaaccggtaacgggtacccgaacggacccgtaaacggtacccgtaacccgtttaccgggtttaaccgggggttttttacccgggggaaccgggggaaaccgggggtaaaccccggtaaacgggtcccggttaacgggttaacccccgggttacccgttaaccggggttacccgaaacccgggtacccccggaaacggggttcccccgttacccccgggttccccccccgggtttacccggggtttaccccccg

SEQ ID NO: 150674 - DNA, 557 bp, Homo sapiens
  misc_feature: GYAE6OF01DEGQC.7.5.A05.1.454.CMB.1.raw
  modified_base (366)..(366): a, c, t, g, unknown or other
  misc_feature (366)..(366): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccaccactgacgttgctggttaataaatatctctcctggtatcaacaatacccaggcaaacgccccaaagtcatcatttatgatgtctataatcggccttcaggggtttccaatcgcttctctgctcaagtctggcgacacggcctccngaccatctctggctccgagctgaagacgaggctgattattactgcagtctcatataacaggacagacagactaccttcgtacggttttccgggacgggacggggacccgaaggtccgtaggacccggttcccgttaacggtccgaacgtccccgaaacggtcccgtaccggccccccgtccggttaccccg

SEQ ID NO: 150675 - DNA, 528 bp, Homo sapiens
  misc_feature: GYAE6OF01A9WQQ.7.5.A05.1.454.CMB.1.raw
  modified_base (420)..(420): a, c, t, g, unknown or other
  misc_feature (420)..(420): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttctaggggtttccaatcgcttctctggctccaagtctggcgacacggcctccctgaccatctctggctccaggctgaagacgaggctgattattactgcagctnatatacaggcagcagcactcgtaggtttcggcgggagggaccgaaagcgtacggacccgtccgtacgggtcacggcccgaaacgggcctccgcccccgtcggtacccg

SEQ ID NO: 150676 - DNA, 517 bp, Homo sapiens
  misc_feature: GYAE6OF01EJMR4.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcacacggcctccctgaccatcctctgggctccgaggctagaagacgaggctgattattactgcagctcatatacaggcagcagcactcgtaggtttcgggcggtacgggaccaaggctagacccgtccgtaggtcaacgcccaaggcctccggcccctcggtaccc

SEQ ID NO: 150677 - DNA, 502 bp, Homo sapiens
  misc_feature: GYAE6OF01E4L5C.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctagattattactgcagctcatatacaggcagcagcactcaggtttcggcggagggaccaagctgaccgtcctaggtcagcccaaggctcgcccctcggtcc

SEQ ID NO: 150678 - DNA, 588 bp, Homo sapiens
  misc_feature: GYAE6OF01CWESH.7.5.A05.1.454.CMB.1.raw
  modified_base (455)..(455): a, c, t, g, unknown or other
  misc_feature (455)..(455): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataatatctctcctggtatacaaacaactaccaggacaaacgaccccaaagtcatctattatgatgtactaataactcgtcttcgacgggtttacaatcgtcttctcgtgctcaagtctcggacgacaccggtcctcctcgacctatcgtcgtcgggcctccgaggtctaggaaacgacggaggcttagtaactttatacgtgactacgacttanaataagtacgaacggcacggcacgctaacgtcggtacgggtttcgggacggaccggtaacaggtccgtacggtacccgtcggtaacggtccgacggacccgtaacggcctacccggtccccgtgggttacccc

SEQ ID NO: 150679 - DNA, 535 bp, Homo sapiens
  misc_feature: GYAE6OF01E1GNN.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctggctccaggctgaagacgaggctgattattactgcagctcatatacaggcagcagcactcgtacggttttcggcgggtacgggaccgaaggcctaggacccggtccgtacggtccgaacgccccaaacgggcctccggtccccccgtcgggttacccg

SEQ ID NO: 150680 - DNA, 542 bp, Homo sapiens
  misc_feature: GYAE6OF01B5PCV.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgcccccaaagtcatcatttatgatgtctataatcggccttcgaggggtttccaatcgcttctctggctccaagtctggcgacacggcctccctgaccatctcgtcggctccgaggctgaagacgaggctgtattattactgcagctcatatacaggcagcagcactcgtaggtttcggcgggagggacccgaaggccgtaggacccggttccgtacggtccgacggtaccccgaacggccctccggtccccccgtcggttacccg

SEQ ID NO: 150681 - DNA, 536 bp, Homo sapiens
  misc_feature: GYAE6OF01DKYJZ.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatatctctcctggtatcaacaatacccaggcaaagcccccaaagtcatcatttatgatgtctataatcgcttcagggtttccaatcgcttctctggctccaagtctggcgacacggcctccctgaccatctctgggctccaggctagaagacgaggctgattattactgcagctcatataacaggacagtcagcactcgtagggttttcggcgggtacgggaccaaggcctagacccggttccgtaacggttcaacggtcccaaacgggtcctaccggcccccgttcggtaccc

SEQ ID NO: 150682 - DNA, 681 bp, Homo sapiens
  misc_feature: GYAE6OF01DNWW3.7.5.A05.1.454.CMB.1.raw
tcagcgtgtctctacacgaccggtgctcgatttagatagatagacgtaggggggggttcggtcgacggaggcgagcgactctcgggacgtctccaccatggcctgggctcctgctattccctcaccctcctcactcaggcacgagggtcgtgggcccacgtcctgccctgactcagcctgcctcccgtgtctgggtctcctcggacgagtcgactcacgatctcctgcactggaaccacactgacgtttgctaggtactaatatctctctggtactcaacaataccacggcaaacgccccaaacgtcagtcgattatgtaatagtaccgtaataagtcggccctttcgaggggtttaccaacgtcgacgttacgtacttggcctccgaacgtccgtcggccgtaccgaacgggaccctaccctcggtaaccctaacgttccgtacccgtagggtccctaccggtaacgggccgttacggaaacggaccggtaacgggacgtacggtaagttacgtttaacgtcgtactacgtactactaactaaactacgaacggtacgaagaccagacctaacgtaccgtaagggttttcgggaccggtagggtaccgtaacggtcggtacggaccggtccgtacggtcgaccgtacccgtaacggcctaccggcccccgtcggtacccg

SEQ ID NO: 150683 - DNA, 521 bp, Homo sapiens
  misc_feature: GYAE6OF01AVWYL.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctgggcctccgaggctggaagacggaggctagatttattactgcagctacatatacaggcagcagcactcgtaggttttcggcgggtaacgggaccaaggctcgaccggtccacggtcacgcccgaaggcctcgccccgtcggtcc

SEQ ID NO: 150684 - DNA, 511 bp, Homo sapiens
  misc_feature: GYAE6OF01CW9SO.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccaggcaaagcccccaaagtcatcatttatgatgtctataatcggcctttcaggggtttccaatcgcttctctgctcaagtctggcgacacggcctccctgaccatctctggctccaggctgaagacgaggctgattattactgcagctcatatacaggcagcagcactctaggttttcggcggacggaccaaggcgtgaccggtcctaggtcacgtcccaacggctcgcccccgtcggtacccg

SEQ ID NO: 150685 - DNA, 514 bp, Homo sapiens
  misc_feature: GYAE6OF01DJUSN.7.5.A05.1.454.CMB.1.raw
  modified_base (243)..(243): a, c, t, g, unknown or other
  misc_feature (243)..(243): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccacactgacgttgctggttataatntctctctgtatcaacaataccaggcaaagcccccaaagtcatcatttatgatgtctataatcgcttcagggtttccaatcgcttctctgctcaagtctggcgacacggcctccctgaccatctctcggctccgaggtctgaagacgaggctagtattattactgcacgtctacatatacgaggcagcagacactcgtacggtttcggcggacggaccagcgtacgaccgtccgtacggtcgacgtaccgacggctccgccccgtcggtacc

SEQ ID NO: 150686 - DNA, 516 bp, Homo sapiens
  misc_feature: GYAE6OF01AJM1F.7.5.A05.1.454.CMB.1.raw
tcagcgtgtctctacacgaccggtgctcgatttagatagatagacaggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggccttcagggtttccaatcgcttctctggctcaagtctggcgacacggcctccctgaccatctctggctccaggctgaagacgaggctgattattactgcagctcatatacagcagcagcactcgtacggtttcggcggtacgggaccgaagccgtagacccgtcgtacggtcacggacccaaggcctccgcccccgtcggtacccg

SEQ ID NO: 150687 - DNA, 676 bp, Homo sapiens
  misc_feature: GYAE6OF01BUM1C.7.5.A05.1.454.CMB.1.raw
tcagcgtgtctctacacgaccggtgctcgattttagatagatagacaggggggggtctcgaggaggcagcgctctcggggtacgtctccaccatggcctgggctctgctagttcctcaccctcctcactctacgggcacagggtccgtgggcccagtcttgcccctggactcagcctgcctccgtggtactggggtctcccgtggacagtcgactcgaccactctcctgcactggaaccaccactcgacgttgcttggttataatatctctctgtatcacactacccaggcaaacgcccccaaagtcgatcagtttagtgatgtctataatcggtactttcgagggtttccaagtcgtactttacttactggcctacccgtaacgttcgtacgggtccgaactaccgggccctaccctcgacccatcctctcgggtcctaccgaggccttggaacggtacgagggtcctaagtattaacttaccgtcgacgagtacttacgaattacgtacgtaaggcctaaggtctaggccgtaccctccgtaaccgggttttcggaccgggtaacgggaacctaaacggtccgttaccggtaccccggttccccggtacgggtacccgaacggtacccccggtaacgggaccccgttccccggtcccccgttccgggttacccc

SEQ ID NO: 150688 - DNA, 542 bp, Homo sapiens
  misc_feature: GYAE6OF01C3MMU.7.5.A05.1.454.CMB.1.raw
  modified_base (301)..(301): a, c, t, g, unknown or other
  misc_feature (301)..(301): n is a, c, g, or t
  modified_base (427)..(427): a, c, t, g, unknown or other
  misc_feature (427)..(427): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatacaacaatacccaggacaaacgcccccaaagtcatcatttangatgtctataatcgcttcgagggtttcaatcgcttctctgctcagtctggcgacacggcctccctgaccatctcgtgggctccgaggctagaagacgaggtctagtattacttacgtgcagtctanatatacagcagcagctactcgtaggtttcggacggacggaccaaggtccgtaggacccgttccgtacggtaccacggtacccgaacggtccctaccggcccccgttcggtacccg

SEQ ID NO: 150689 - DNA, 544 bp, Homo sapiens
  misc_feature: GYAE6OF01CMLNI.7.5.A05.1.454.CMB.1.raw
  modified_base (365)..(365): a, c, t, g, unknown or other
  misc_feature (365)..(365): n is a, c, g, or t
  modified_base (442)..(442): a, c, t, g, unknown or other
  misc_feature (442)..(442): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctgtatcaacaatacccaggcaaagcccccaaagtcatcatttatgatgtactataatcggcttcgagggtttccaatcgcttctctgctcaagtctggcgacacggcctcccngaccatctcgtcgggcctccgaggctagaagacgaggctgatttattactgctagctacatataacgaggcaagcancactcgtacggtttcggcggaacgggacaacggtctacggtacccggttaccgtaggtaccacggtaccccgaacggtcctccggtcccccgtcgggtaccc

SEQ ID NO: 150690 - DNA, 514 bp, Homo sapiens
  misc_feature: GYAE6OF01CWCLE.7.5.A05.1.454.CMB.1.raw
  modified_base (257)..(257): a, c, t, g, unknown or other
  misc_feature (257)..(257): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataatatctctcctgtatnaacaataccaggcaaagcccccaaagtcatcatttatgatgtctataatcggtcctttcagggtttccaatcgtcttctctggctccaagtctggcgacacggccctcctgaccatctctcggctccgaggctagaagacgaggactgtattattactgcagctacattatacagcagcagcactcaggttttcggcggagggacaagctacgacgtcctaggtcacgacccgaaggcctacgccccgtcggtaccc

SEQ ID NO: 150691 - DNA, 509 bp, Homo sapiens
  misc_feature: GYAE6OF01AQEQ8.7.5.A05.1.454.CMB.1.raw
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcagggtttcaatcgcttctctgctcaagtcngcgacacgcctccctgaccatctctgggctccaggctgaagacgagctgattatactgcagctcatatacagcagcagcactctaggtttcggcggaggaccgagcgtagacccgtcgtacggtcacggtcccgaaggtcctaccggcccccgtggtaccc

SEQ ID NO: 150692 - DNA, 491 bp, Homo sapiens
  misc_feature: GYAE6OF01BQN8A.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaagccccaaagtcatcatttatgatgtctataatcggccttcagggtttccaatcgcttctctggctccaagtctggcgacacggcctccctgaccatctctggctcagctgaagacgaggctgattattactgcagctcatatacagcagcagcactcgaggtttcggcggaggaccgagctgaccgtctagtcagccaagctcgccccgtcggtcc

SEQ ID NO: 150693 - DNA, 556 bp, Homo sapiens
  misc_feature: GYAE6OF01BX3J1.7.5.A05.1.454.CMB.1.raw
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatacaacaatacccaggacaaacgcccccaaagtcatcatttatgatgtctataatcgccttcagggtttccaatcgtcttctctgctcaagtctggcgacacggccctccctgaccatctcgtggctccgngctagaagacgaggctagattattatgacagctanatataacgagacgagtaccgagacacgtacgtacgggttttcggacgggtacgggaaccgaaggtcctacggacccggttccgtacgggtacaacggcccgaacggccgttcccgcccccgtccggtacccg

SEQ ID NO: 150694 - DNA, 527 bp, Homo sapiens
  misc_feature: GYAE6OF01DMDC4.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttaataaatntctctcctggtatcaacaatacccaggcaaacgccccaaagtcatcattatgatgtctataatcggcttcagggttccaatcgcttctctgctcaagtctggcgacacggcctcctgaccatctctggctccaggctagaagacgagctgattattactgcagctcatatacagcagtcagcactcgtacggttttcggcggacgggaccgaagccgtagacccggttccgtacggttccaacggtcccaaacggcctccggcccccgtcggtaccccg

SEQ ID NO: 150695 - DNA, 699 bp, Homo sapiens
  misc_feature: GYAE6OF01EEP3T.7.5.A05.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagcgtgtctctacacgaccggtgctcgatttagatagatagactaggggggggttcgtcgaggaggcaggcggctccttcggggaccgtcgtccacccaagtcggtccctgggtctctgctattcctcaccctctcactcgaaggggctaccacgggtcgtggggaccccagggtcttgccctgtacgtttcctaggtccttagttcctaccggttgtcctggggtcttccgtgggtacagtcgattcgacgatcctccggtgcctacgtcggaaaccncctacggtcacgttgctggttactaatntcgtctcctggtatcaactaatacccagtcaaagcccaaagtctagtccatttagtcgtactggtacgtataaggtcggtcgttcgtacgggttaccaaagtacgacgtactacggtaggtctaaccaaaaggttctagggtacggacctacggtcccgtccgtacggaacctattcctcgtcggtccttccgaaggctaacggaaacgacgaacggtacttcgtaactttaattacgtcgactaaggtctaactagtaacttagaggtacgaggacaacgacgacttggtacgggtttacggtacggtagggacctaaggacgtaggtaccggtcggtaacggtacggaacggaccggaacgggcctccggccccttcggggttaaccc

SEQ ID NO: 150696 - DNA, 547 bp, Homo sapiens
  misc_feature: GYAE6OF01EXDFO.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcactggaaccaccactgacgttgctggttataaatatctctcctgtatcaacaataccaggacaaacgccccaaagtcatctatttangatgtctataatcgcttgtagggttcaatcgtcttctctggctactaagtctcggcgacacggccctcctacgacctatctcgtgggcttccgagctaggaagacgaggctagatttaatactgactagctcatacacgtaggacagcagctacgttacgtacgggtttcgggacgggacgggaaccaaggtccgtagacccgtcgtacggtccaacgccccgaaggtcctcccggtcccctcgggtacc

SEQ ID NO: 150697 - DNA, 518 bp, Homo sapiens
  misc_feature: GYAE6OF01CTQDV.7.5.A05.1.454.CMB.1.raw
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
  modified_base (503)..(503): a, c, t, g, unknown or other
  misc_feature (503)..(503): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagccctgcctccgtgtctgggtctcctggacagtcgatcaccatctcctgcactggaaccaccactgacgttgctggttataatatctctcctggtatcaacaataccaggcaaagccccaaagtcatcatttangatgtctataatcggtccttcgagggtttcaatcgcttctctggctcaagtctggcgacacggcctcccngacctatctcgtcgggccttccaggctaggaagacgaggtctgtattattactgcagtctacatatacagcagcagcactcgtaggtttcggacgtaacggacaacgctcgaccgtcctaggtccacgcccaaggcncgccccgtcggtacc

SEQ ID NO: 150698 - DNA, 536 bp, Homo sapiens
  misc_feature: GYAE6OF01B7W7V.7.5.A05.1.454.CMB.1.raw
  modified_base (417)..(417): a, c, t, g, unknown or other
  misc_feature (417)..(417): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctgtatcaacaataccaggacaaagcccccaaagtcatcatttatgatgtctataatcgtcttcagggtttcaatcgtcttctctggctcaagtctggcgacacggcctccctgaccatctcgtcggctcgagctgaagacgaggctgattattatgcagctnattactacagcagcagcactcgtacggtttcggacgggacggaccgaaggtccgtaggaccggttccgacggttccaaccggacccgaacggtccgtaccggcccccgttcggtacccg

SEQ ID NO: 150699 - DNA, 621 bp, Homo sapiens
  misc_feature: GYAE6OF01CPNCL.7.5.A05.1.454.CMB.1.raw
  modified_base (313)..(313): a, c, t, g, unknown or other
  misc_feature (313)..(313): n is a, c, g, or t
  modified_base (470)..(470): a, c, t, g, unknown or other
  misc_feature (470)..(470): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttaggttaataaatactctctcctggtactacaaacaactaacccaggaccaaacgaccccaaagtacatactatttangatgtactaagtaactcggtaccttcgtacgggtttacaactcgtcttctcgtcggtccttacgaacgttcgtacggcgaccgtaccggtacctcccgtacgaccacgtctcgtcggccttcgagtcgtagaagcgaggtctagtaattacttacgngtacacgtctactaataactacgacggtcaacgacgagtacctacgtcggtacgggtttacgggacggtaacgggaccgtaaaggtcgtacgtacccggttcgtacggtacgacggtacccgaacggcctccccggccccgtacggtaccc

SEQ ID NO: 150700 - DNA, 541 bp, Homo sapiens
  misc_feature: GYAE6OF01ASBC9.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtactataatcgccttcgagggtttccaatcgcttctctgctcaagtctggcgacacggccctccctgaccatctctcggctccgaggtctagaagacgaggctagtattattactgcagctcatatacagacagacacgactacgtcgtacgggtttcggacgggtacgggaccgtaaggccgtagacccgtccgtaggtaccacgtacccgaacggcctccggtccccgtcggtacccg

SEQ ID NO: 150701 - DNA, 541 bp, Homo sapiens
  misc_feature: GYAE6OF01CE57T.7.5.A05.1.454.CMB.1.raw
  modified_base (300)..(300): a, c, t, g, unknown or other
  misc_feature (300)..(300): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaacgcccccaaagtcatcatttangatgtctataatcggcttcgagggtttccaatcgtcttctctggctccaagtctggcgacacggccctccctgacccatctcgtgggcctccgaggctagaagacgaggctagtatttacttacgtgacagtctctatatacaggcagcagcactcgtaggtttcggcgggtacggaccaagtccgtaggacccgttccgtacggtccacgtacccgaagccgtccgccccgtcggtaccc

SEQ ID NO: 150702 - DNA, 552 bp, Homo sapiens
  misc_feature: GYAE6OF01CFTUH.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccacactgacgttgctggttataaatatctctctgtatcaacaactaccaggacaaacgccccaaagtcatctatttatgatgtactaataactcgtcttcgtacgggttccaatcgtcttctcgtgctacagtctgcacacgcctcctcgactatctcgtcggctcgacggctagaagacgaggtactgtattatacgtgacacgtctcaatactacgaggcagcagctacgtacgtacggtttcggcgggaacggaccgtaacgtccgtaggacccgttccgtaggtacccacgacccgaacggtcccgtacccgtccccggtcggttacccg

SEQ ID NO: 150703 - DNA, 504 bp, Homo sapiens
  misc_feature: GYAE6OF01B2PIA.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacggcctccctgacccatctctgggctccagctgaagacgaggctgattattactgcagctcatatacaggcagcagcactcgaggtttcggcggaggaccgagcctgaccgtctaggtcacgcccaaggcctcgcccccgtggtccc

SEQ ID NO: 150704 - DNA, 513 bp, Homo sapiens
  misc_feature: GYAE6OF01BTW29.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcgtaggttttcggcggtagggaccaaggctggacccgtccgtaggtcacgcccaaggcctcgccccccgtggtccc

SEQ ID NO: 150705 - DNA, 611 bp, Homo sapiens
  misc_feature: GYAE6OF01C11N9.7.5.A05.1.454.CMB.1.raw
  modified_base (302)..(302): a, c, t, g, unknown or other
  misc_feature (302)..(302): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcaccatctcctgcactggaaccacactgacgttgctggttataaatatctctcctggtatcaaacaactacccaggacaaacgcccccaaagtcatcatttangatgtctataatcgcttcgagggtttcaatcgcttctctggctcagtctggcgacacggcctccgtgaccatctcgtcggtctccgaggctaggaagacggaggtcttaggtaatttacgtttaactcgactagtactacgaattataacgagggcctagacagtccaaccgttacgtacggggttttaccggacggggtaaccgggaaccgaacggtcgtacggtacccggttacccggttaacgggttacccgacggtaccccggaaacgggtcccgttacccggtccccccgttcgggttaccccg

SEQ ID NO: 150706 - DNA, 530 bp, Homo sapiens
  misc_feature: GYAE6OF01CGM5U.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagccctgcctccgtgtctgggtctcctggacagtcgatcaccatctcctgcactggaaccaccactgacgttgctggttaataatatctctcctggtatcaacaatacccaggcaaagcccccaaagtcatcatttatgatgtctataatcggccttcgaggggtttccaatcgtcttctctggctccaagtctggcgacacggcctccctgaccatctctggctccaggctagaagacgaggctgattattactgcagctcatatacaggcagcagcactcgtaggtttcggcgggacgggaccgaaggcgtagacccggtccgtacggtacacgcccgaacggccgtccgcccccgtcggtacccg

SEQ ID NO: 150707 - DNA, 503 bp, Homo sapiens
  misc_feature: GYAE6OF01EJYPM.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctggctccaagtctggcgacacgcctccctgaccatctctggctccagctgaagacgaggctgattattactgcagctcatatacaggcagcagcactcgtaggtttcggcggagggaccaaggctgaccgtcctaggtcacgcccaaggcctcgcccccgtggtccc

SEQ ID NO: 150708 - DNA, 549 bp, Homo sapiens
  misc_feature: GYAE6OF01CLLM9.7.5.A05.1.454.CMB.1.raw
  modified_base (297)..(297): a, c, t, g, unknown or other
  misc_feature (297)..(297): n is a, c, g, or t
  modified_base (382)..(382): a, c, t, g, unknown or other
  misc_feature (382)..(382): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatatctctcctggtatcaacaataccaggacaaacgccccaaagtcatcatttangatgtctataatcggtcttcgtaggggtttccaatcgcttctctggtctccaagtctggcgacacggtcctccctagacatctcnggctcgaggctagaagacgaggctgattattactgcagctacataatacgaggcgacgcaagcaacgtcgtagggttttcgggcgggaaggaaccgaacgcgtacggaccggttaccgtagggttaccacggacccaacggccgtcccgcccccgtcggttaccccg

SEQ ID NO: 150709 - DNA, 576 bp, Homo sapiens
  misc_feature: GYAE6OF01CA4N4.7.5.A05.1.454.CMB.1.raw
  modified_base (299)..(299): a, c, t, g, unknown or other
  misc_feature (299)..(299): n is a, c, g, or t
tcagcgtgtctctacacgaccggtgctcgatttagatagatagacgaggggggggtctcaggaggcagcgctctcgggacgtctaccaccatggcctgggctctgctattcctcaccctcctcactcagggcacagggtcgtgggcccagtctgccctgactcagcctgcctccgtgtctgggtctccgtggacagtcgatcaccatctcctgcactggaaccacactgacgttgctggttataaatatctctcctggtatcaaacaatacccaggcaaagccccaaagtcatcattangatgtctataactcggccttcgagggtttccaatcgcttctcgtggctccaagtctggcgacacggcctccgtgacctatcctctcgggctccgaggctaggaacgacggaggctacgatttacgttaactcgtacgacgtctacataactacgtaggaccagaccagtcacgttcgtagggttttcgggacgggtaaacgggaccaaggtcctacggacccggtcgtaccgggtaccacggtacccaaggccctccggtcccccgtcggtaccccg

SEQ ID NO: 150710 - DNA, 603 bp, Homo sapiens
  misc_feature: GYAE6OF01A40W1.7.5.A05.1.454.CMB.1.raw
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (443)..(443): a, c, t, g, unknown or other
  misc_feature (443)..(443): n is a, c, g, or t
tcagcgtgtctctacacgaccggtgctcgatttagatagatagacagggggggtcgtcgaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaaatacccaggcaaacgcccccaaagtcatctatttatgatgtntaataatccggtcttcgtagggtttccaatcgcttcnctgctcagtctggacacaccggcctccctagaccattcctcgtgggtcctaccgaggctcgaaacgacggaggtcctagtaatttacttactgaccngtcctataataactacaacgggcaagtcacgactacctacggttacgggtttccgggagggtaacccgggaacttaaccggccgttacgaccccggttccgtaaaggtccccaacggacccccggtaaggtccctacccggtcccccccgtcggtaaccc

SEQ ID NO: 150711 - DNA, 524 bp, Homo sapiens
  misc_feature: GYAE6OF01DHF22.7.5.A05.1.454.CMB.1.raw
  modified_base (298)..(298): a, c, t, g, unknown or other
  misc_feature (298)..(298): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgccccaaagtcatcatttangatgtactataatcggcctttcgagggtttccaatcgcttctctggctcaagtctggcgacacggccctccctgaccatctctgggcctccgaggctaggaagacggaggctgtattattactgacagtctacatataacaggacagcagcactcgtacgggtttcggacggagggaccagcgtgaccgtcaggtcacgcccgaaggcctccgccccgtcgtaccc

SEQ ID NO: 150712 - DNA, 538 bp, Homo sapiens
  misc_feature: GYAE6OF01BQF5P.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactggaaccaccactgacgttgcttggttataaatatctctcctggtatcaaacaataccaggacaaacgccccaaagtcatctatttatgatgtctataatcgcttgagggttcaatcgcttctctgctactaagtctggcgacgacggtcctccctcgaccatctcgtcggcctcgaggctagaagacgaggtctagtatttattactcgcagtctacatatacgagcgagcagctacgtcgtaggtttcggacggtacggaaccgagtcgtacgacccggttcgtacgtcgaccgtccgaacggcctccgccccgtcggtacccg

SEQ ID NO: 150713 - DNA, 513 bp, Homo sapiens
  misc_feature: GYAE6OF01BDTXJ.7.5.A05.1.454.CMB.1.raw
  modified_base (317)..(317): a, c, t, g, unknown or other
  misc_feature (317)..(317): n is a, c, g, or t
  modified_base (417)..(417): a, c, t, g, unknown or other
  misc_feature (417)..(417): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgccttnaggggtttccaatcgcttctctggctccaagtctggcgacacggcctccctgaccatctctgggctccaggctgaagacgaggctgatttaattactgcngctcatatacaggcagacagcacgtctagggtttcggcgggaggaccaagctgaccgtcgtagtcacgcccgaaggcctcgccccgtcggtacccg

SEQ ID NO: 150714 - DNA, 756 bp, Homo sapiens
  misc_feature: GYAE6OF01DEE9T.7.5.A05.1.454.CMB.1.raw
  modified_base (204)..(204): a, c, t, g, unknown or other
  misc_feature (204)..(204): n is a, c, g, or t
  modified_base (317)..(317): a, c, t, g, unknown or other
  misc_feature (317)..(317): n is a, c, g, or t
tcagcgtgtctctacacgaccggtgctcgatttagatagatagacgtaggggggggtcgtcaggaggcagcgctctcgggacgtctccaccatggcctgggctctgctattcctcaccctcgtcactcaggcacagggtcgtggcccagtctgcctgactcagcctgcctcgtgtctgggtctcctggaccagtccgatcaccnctcctcctgccactggaaccacgtactgacgttgccttaggtaataaattctctcgtacctaggtactacaaactaatacccaggacaaacgaccccaaagtcatactattangatcgtactaataatccggtaccttacggtagggtttccaacgtcgtacttctcgtggacctcgtaagtcgtcggcgaccgacggtccctccgtagtacctactccgtcgtacggtcctaccgacggacgtacggaacggacgtaggacgtaggttaactttaagttacgttcgtacgtacgtacctacgtaacttaacgtaacgtaacggtactaaccgaccggtaccgtaccgttaaccgtttaccgggttaaccggggtttttaccggggaaccgggggtaaaccgggtaaaccggtaaacggtaccgggttaacccgggttaaccccggttaaccccgggttaaaccgggttacccggtaacccgggtaaccccgggtaaaccgggttaccccgttacccccggtacccccgggtttacccgggttaacccccgg

SEQ ID NO: 150715 - DNA, 538 bp, Homo sapiens
  misc_feature: GYAE6OF01DSD3B.7.5.A05.1.454.CMB.1.raw
  modified_base (372)..(372): a, c, t, g, unknown or other
  misc_feature (372)..(372): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgacgttgctggttaataaatatctctctggtatcaacaatacccagacaaacgccccaaagtcatcatttatgatgtctataagtcgtcttcgtagggtttcaatcgtcttctctgctcgaagtctggcgaccacggccctcccngacctatctcgtcgggtcctccgaggctaggaacgacgagcgtagtattatactgcngtctanatatacgaggcagacagcactcgtagggttcggacgggacggaacacggctcggaccgtccgtaggcgaaccgccgaacggcctcccggccccgtcggtaccc

SEQ ID NO: 150716 - DNA, 777 bp, Homo sapiens
  misc_feature: GYAE6OF01CKDRS.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacgagggtcgtgggcccagtctcgccctgactcagcctgcctccgtgtctgggtctcctggacagtcgatcaccatctcctgcactggaaccacactgacgttgctggttataaatntctctcctgtatacaacaatacccaggacaaacgccccaagtcatctatttatgattgtactaataacgtccgtacctttacgtacgggtttaccaagttccggtacctttccgtcgtcggtaccttacccgtaagttccgtcgggacccgtaaccgtacccgggtccccttaccccgtacgtaaccctacttaccgttccggtcgggtacccgttaccggacgggtaccgttacgggaaacggtaaccggaacgggtcgttaggtaacttttaacgttaacgtcggtactaccggtaccttactaacgttaacgtaacgaacgggccgtaacggcctaacggaccgttaaccgttaccggttacggggttttacccgggaaccggggtaccggggtaaaccgtaaccggggtcccgttaccggggtaaccccggtttaccccggtacgggttaaccccaacccgggttaacccccggaaacgggttacccccgttccccgggtaaccccccccgttcggggttaccccc

SEQ ID NO: 150717 - DNA, 515 bp, Homo sapiens
  misc_feature: GYAE6OF01DI0UD.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcattatgatgtctataatcggccttcagggtttccaatcgcttctctggctccaagtctggcgacacggcctccctgaccatctctgggcctccaggctgaagacgaggctgattattactgcagctcatatacaggcagcagcactcaggttttcggcggacgggaccagcgtagaccggttcctaggtccacgccccgaaggcctccgcccccgtcggtacccg

SEQ ID NO: 150718 - DNA, 541 bp, Homo sapiens
  misc_feature: GYAE6OF01D30SI.7.5.A05.1.454.CMB.1.raw
tcagcgtgtctctacacgaccggtgctcgatttagatagatagacaggggggggtctcaggaggcagtgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggcttcagggtttccaatcgcttctctggctcctaagtctggcgacacggcctccctgaccatctctggctccagctgaagacgaggctgatttatactgcagctacatactacgacggacagcagccacgtcgtagggttttccggacgggtacgggaccaaggcgtagacccggttccgtagggtccaacggccccgaaagggccctaccggccccccgtcgggtaccc

SEQ ID NO: 150719 - DNA, 540 bp, Homo sapiens
  misc_feature: GYAE6OF01CMU18.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggtataaatatctctcctggtatcaacaatacccaggcaaacgcccccaaagtcatcatttatgatgtctataatcggcttcgagggtttccaatcgcttctctgctcaagtctggcgacacggccctcctgaccatcctcgtgggcctccgacggctaggaagacgaggctagtattattactgctagctcaatataacaggacagcagctacgtcgtagggttttccgggacgggacgggaccgaagccgtagacccggttcgtacggtccacgacccgaaggcctccgcccccgtcggtaccc

SEQ ID NO: 150720 - DNA, 527 bp, Homo sapiens
  misc_feature: GYAE6OF01A0FWM.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcattggaaccaccactgacgttgctggttataaatatctctcctggtatcaacaatacccaggcaaagcccccaaagtcatcatttatgatgtctataatcggcttcagggtttccaatcgcttctctggctccaagtctggcgacacggcctccctgaccatctctgggctccgaggctgaagacgaggctgattattactgcagtctcatatacaggcagcagcactcgaggttttcggcggacgggaccaaggccgtgacccggtcctaggttacccacgaccccgaagggcctccggcccccgtcgggtaccc

SEQ ID NO: 150721 - DNA, 515 bp, Homo sapiens
  misc_feature: GYAE6OF01DSXKL.7.5.A05.1.454.CMB.1.raw
  modified_base (411)..(411): a, c, t, g, unknown or other
  misc_feature (411)..(411): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccaggcaaagccccaaagtcatcatttatgatgtctataatcggccttcagggtttccaatcgcttctctggctccaagtctggcgacacggcctccctgacccatctctcgggctccaggctgaagacgagctgattattacngtcagctcatatacagcagcagcactcgtaggtttcggcgggagggaccaaggtctaggaccgtccgtaggtccacgcccaaggcctcgccccgtcggtacccg

SEQ ID NO: 150722 - DNA, 525 bp, Homo sapiens
  misc_feature: GYAE6OF01DE8VS.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgcctgggtctcctggacagtcgatcaccatctcctgcactggaaccacactgacgttgctggttaataatatctctcctggtatcaacaataccaggcaaacgccccaaagtcatcatttatgatgtactataatcggccttcgagggttccaatcgtcttctctgctccaagtctggcgacaccggcctcctcgactactctcgtcggctccaggctagaagacgaggctgtattattactgcagctcatatacaggcagtcagcactcgtaggtttccggacggacgggtaccaacgtcgtacgtaccgtcgtacggtcacgtaccgaacggctccgccccgtcggtacc

SEQ ID NO: 150723 - DNA, 822 bp, Homo sapiens
  misc_feature: GYAE6OF01BHFX2.7.5.A05.1.454.CMB.1.raw
tcagcgtgtctctacacgaccggtgctcgatttagatagatagacgtagggggggggttctcgaggaggcaggcggctccttcggggaccgtcgtccacccaagtcggtccctgggtctctgctattcctcaccctctcactcgagggcacacgggtcgtggggaccctagggtctggaccctgtacgttcctaggtccgttgtaccgtaccggtgtcctggggtctccgtgggacagtcgtagtcgacctagtcggtcctgtcgacctggggaacccggtaccacgtggaccgtttcgccttagggtttaataaaactactccttcttccgttaggtttaccttacgaaactaaacgttacccgaggtacaaacggccccgtaaaggtccactcgtactttacgtaggtaggttggtacgttaggtaacgtaccggtacctttacggtaacggggtttaccaaagttcgtacgttacgtacgtacgggtacttacgtaacgttcgtcggtcgtacgaccgggtcccggtcccgtcggaccctacgttcctcgtacgggtaccttacccgacgggtacctaacggtaacggtaccggtaggacttaggtactttaacgttaacgtacgtacgaacgtcgtacgtaagtaacgtaaccgaacggacgtacgaccggtacgttacctaacgttacgtacggggtttaccgggacggggtaccgggaacggtaacggaccggttcgggtacccggttccgtaacgggtaccgaccgggtacccggtaaacgggcccgttacccgggcccccgttcggttaccccg

SEQ ID NO: 150724 - DNA, 527 bp, Homo sapiens
  misc_feature: GYAE6OF01BBNWE.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcgagggtttcaatcgcttctctggctccaagtctggcgacacggccctccctcgaccatctcgtcggctccaggctgaagacgaggctagtattattactgcagctcatatacaggcagcagcacgtcgtacgggtttcgggacggtacgggaccaggtctacgaccgtccgtacggtcacgcccgacggcctcgtccccgtcggtacccg

SEQ ID NO: 150725 - DNA, 542 bp, Homo sapiens
  misc_feature: GYAE6OF01BHYKV.7.5.A05.1.454.CMB.1.raw
  modified_base (355)..(355): a, c, t, g, unknown or other
  misc_feature (355)..(355): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagcccccaaagtcatcatttatgatgtctataatcgcttcagggttccaatcgcttctctgctcaagtctggcgacncgcctccctgaccatctcgtggctccgagctagaagacgaggctagattattacgtgcagtctcatactacgagcagcagcacttcgtacgggtttcggacgggacgggacctaaggccgtacggtacccggttcctacgggtaccaacggtccccgaacggccctccggccccccgtggtaccccg

SEQ ID NO: 150726 - DNA, 539 bp, Homo sapiens
  misc_feature: GYAE6OF01D6YH8.7.5.A05.1.454.CMB.1.raw
  modified_base (247)..(247): a, c, t, g, unknown or other
  misc_feature (247)..(247): n is a, c, g, or t
  modified_base (360)..(360): a, c, t, g, unknown or other
  misc_feature (360)..(360): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctctgtatcaacaatacccaggacaaacgcccccaaagtcatcatttatgatgtactataatcggtcttcgtagggtttccaatcgtcttctctgctcaagtctggcacncgcctccctgaccatctcgtcgggcctccgggctaggaacgacggaggctgtattacttactgcagtctcaataagtacgaggcagcagctacgtcgtaggtttcggacggacggaccgaagcgtcgtaccgtcgtagtccgacgacccgtaaggcctaccgccccgtcgtcctacccg

SEQ ID NO: 150727 - DNA, 541 bp, Homo sapiens
  misc_feature: GYAE6OF01B5A11.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataatatctctcctggtatcaacaatacccaggcaaagccccaaagtcatcatttatgatgtctataatcggccttcagggtttcaatcgcttctctggctccaagtctggcgacacggcctcctgaccatctctggctccaggctgaagacgaggctagattattactgtcagctcatatacaggcagcagctacgtcgtagggttttcggacggacgggaaccgaacgtcgtaggacccggttccgtaacggtaccgaacggtccccgaacggtccgtacccggccccccgttcgggtaccc

SEQ ID NO: 150728 - DNA, 518 bp, Homo sapiens
  misc_feature: GYAE6OF01DWJXI.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggccttcaggggtttccaatcgcttctctggctccaagtctggcgacacggcctccctgaccatctctgggctccaggctagaagacgaggctgattattactgcagctcatataacaggcagcagcactcgaggttttcggcggagggaccaagcgtacgaccgtccgtacggtcacggcccaaggctcgccccccgtcggtacccg

SEQ ID NO: 150729 - DNA, 651 bp, Homo sapiens
  misc_feature: GYAE6OF01BB1JO.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatntctctcctgtatcaaacaatacccaggcaaacgccccaaagtcatcatttatgatgtctataatcgcttgagggtttccaatcgtcttctctggctcaagtctggcgacacggccctccctcgacctatcgtcgtcgggtctaccgacggtcgtagaaacggaacggtaggtaccgtaggtaatttaacgtttaacctggtactacggtccttactaacttacgttaacgacgggaccgaagtccgaacgtaccgtaaccgttccggtaacggggttttccgggaccggggtacgggaaacccggtaacggccgttacgggaacccggttccgttaacgggtacccgaaccggtaaccccgaaccgggtacccttcccgggtcccccccgttgggttaaccccccg

SEQ ID NO: 150730 - DNA, 729 bp, Homo sapiens
  misc_feature: GYAE6OF01AH1EB.7.5.A05.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
tcagcgtgtctctacacgaccggtgctcgatttagatagatagacaggggggtcgtcgaggaggcgagcgctctcgggacgtctccaccactggcctgggctctgctattcctcaccctcctcactcacggcacagggtcgtgggcccagtctgccctgactcagcctgcctcgtgtctgggtctccgtggacagtcgatcaccntctcctgcactggaaccnccactgacgttgcctaggttataaatntcctctcgtagtactacaacaactaccgagaccaacgacccctaatacactactattactagtattcgtactatacgtcggtccttacgtacgggtttaccacgtcgtcttcgtcgtcgtctacgacgtcgtcggtccgtacgtaccgtccctcccgtacgtaccctacgttcctccggtacggtcctacccgtaggtaccgtacggtaaacggtaccggtacggtaccgttaagttaacgttttacgttacgtcgtaccgacttaccgttaactaacgttaactaaccggtaacggtaccgtaacgtaccgtaccgtaccgttaaccgttacggttaccggggtttaccgggacggggtaaaccgggtaaccgtaacgggtccgttaacccgggtacccgttacccgggtaacgggtacccgaacccgggtacccggtaccggtacccgtaccccgggttcccccgttcggtaccccg

SEQ ID NO: 150731 - DNA, 766 bp, Homo sapiens
  misc_feature: GYAE6OF01A417N.7.5.A05.1.454.CMB.1.raw
tcagcgtgtctctacacgaccggtgctcgatttagatagatagacgtagggggggtctcgaggaggcaccgccgcgttcctcgggacgtctccacctagtggacctgggctctgctattcctcaccctcctcactcagggcacgtaggggtcgtgggcccagttcgttcgtcccttgaccttcttaaggcctcgccgtccgtgtcgtgggtcctccgtggacgaggtcgatcggaccattccgtcctgccacggtcggaaccaccactgaccgttgctggttaataaactatcgtactcctaggttactactaactaactacccaggtacaaacgcccccaaaagtccgactccaagtttactcggaagtcggtacttaagtaaacgttccggtccgtttcgtacggggtttacctaaagttccgtactttactcgtcggtacttacccgtaaagttctagggtaccgaacacccgggtacccttcccgtagaacccgtaagtcctacgtacgggtcctacccgtaggtccttacggaaacggtaaccggacggtactaaggtaactttaacgttaccgtgtacctagtacctaacgtaagttaactaccgaacggtcgaacggaccgtacgtacgaccgttacgtacgggttttccgggacgggtaacggtaaccgtaaggtccgtagggtacccggtaccggtacgggtcccgaacggtaccccggaagggttcccgttccgggtcccccgggtcggtacccgg

SEQ ID NO: 150732 - DNA, 573 bp, Homo sapiens
  misc_feature: GYAE6OF01C25GD.7.5.A05.1.454.CMB.1.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggccctagtctgccctgactcagcctgcctccgtgtctgggtctccgtggacagtcgatcaccatcctcctgcactggaaccaccactgacgttgctggttaataaatntctctcctggtatcaacaactaccagacaaacgccccaaagtccatcctatttangatgtactataagtcggcctttcgtagggtttccaatcgcttctctggctccaagtctggcacacggcctaccgtgacctacgtctcgtcgggtcctccgacggtctacgaacgacgacggtcgtagtattaattacgtgtacgacgtactactatataacgaggactagcgacgcacttcgtagggtttccggacgggacgggaccgaacggcgtacggaccggtcgtacggtcacgtaccgacgtccgtccgccccgtcggtacccg

SEQ ID NO: 150733 - DNA, 501 bp, Homo sapiens
  misc_feature: GYAE6OF01DSH0V.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataatntctctcctggtatcaacaatacccaggcaaagccccaaagtcatcatttatgatgtctataatcggcctttcagggtttccaatcgcttctctggctcagtctgcgacacggcctccctgaccatctctgggcctccgaggctgaagacgaggctgattattactgcagctcatatacaggcagcagcactcgtaggttttcggcggaggaccagctgaccgtccgtagcacgcccaaggctcgccccgtgtaccc

SEQ ID NO: 150734 - DNA, 599 bp, Homo sapiens
  misc_feature: GYAE6OF01EDVOG.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctgtatcaacaataccagacaaacgaccccaaagtcatcatttatgatgtctataatcgtccttcgtagggtttccaatcgtcttctctcgctcaagtctggacgacacggtcctccctgacctactctcgtcgggcctccgagctagaacgacgagctagtatttagttactgtcagtctactaatacgtaacgacggacagtaccgacgtctaaccgtcgtaacgggtttcgggaacgggaccgggaaaccgtaggaccgttacggtacccggttccggtaacggtaccgtaaccggtaccccgaacgggacccgttcccggtcccccccgtcgggttaccccg

SEQ ID NO: 150735 - DNA, 579 bp, Homo sapiens
  misc_feature: GYAE6OF01D6DIN.7.5.A05.1.454.CMB.1.raw
  modified_base (248)..(248): a, c, t, g, unknown or other
  misc_feature (248)..(248): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaatntctctcctgtatcaacaactacccaggacaaacgccccaaagtcatctatttatgatgtactataatcggtccttgtagggtttcaatcgtcttctctggtctctaagtctggcgacgacggccctccctgaccatctcgtcgggcctccgaggtctaggaagcgaggctgtattattacgngcgacnctcatacacgaggcagcgacgctacgtcggttacgggtttcgggaccgggtacgggaaccaacggtccgtacggtacccggttccgtaacggtccgaaccggtacccggaaccggtccctcccggcccccgttcgggtccccg

SEQ ID NO: 150736 - DNA, 598 bp, Homo sapiens
  misc_feature: GYAE6OF01DNP6M.7.5.A05.1.454.CMB.1.raw
  modified_base (450)..(450): a, c, t, g, unknown or other
  misc_feature (450)..(450): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgacgttgcttaggttaataaatctcttctcctggtactacaaacaatacccaggaccaaacgacccccaaagtcatctatttatgtatgtactaatatccgtcctttcgtagggtttaccatcgtcttctctgctcagtctggcgacacggcctccgctacctatcctcgtcggtcctacgacgtctagaacgacggagctgtatttagtactgctagtctanatactacgaggcacgcagtactacgttcggttacgggttccggacgggtaacggaaccgaacggtccgtaccggtacccggttcgtaccgggtaccgacccggtacccgtaacgggtaccctccccggtaccccgtccggttaccccg

SEQ ID NO: 150737 - DNA, 612 bp, Homo sapiens
  misc_feature: GYAE6OF01EH6JJ.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacaggtcgatcaccatcctcctgcactggaaccaccatgacgttgctggttaataaatntctctcctgtactcaacaactaccagacaaacgaccccaaagtcatctatttatgtatgtactataacgtcggtaccttcgtacgggttccaagtcgtcttctcgtgctactagtctcggacgacacggccctcccgtagacctactcgtcgtcggcctccgaggtctacgaacgacgaggcttagtaactttagttactcgactacgtcttacattaacacgtaacgcacgaccgagacctacgttcgttacgggtttcggacgggtacggaaccgtacgtcgtacggtaacccggttcgtaacggtaccgaaccggtacccgtaaacgggtcccgttcccggtcccccgttcggtaccccg

SEQ ID NO: 150738 - DNA, 549 bp, Homo sapiens
  misc_feature: GYAE6OF01CHCAK.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatatctctcctggtatcaacaataccaggcaaagcccccaaagtcatcatttatgatgtctataatcggccttcgagggtttccaatcgcttctctggctccaagtctggcgacacggcctccctgaccatcctctggcctccgaggctagaagacgagctgtattattactgctagtctacaatatacgaggcagcagcctactcgtagggttttccggacgggacggtaccgaaggtccgtacgacccgttccgtacggtccgaacgccccgaacggccttcccggcccccgtcggtaccccg

SEQ ID NO: 150739 - DNA, 540 bp, Homo sapiens
  misc_feature: GYAE6OF01CVE9Q.7.5.A05.1.454.CMB.1.raw
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggacaaagccccaaagtcatcatttatgatgtctataatcgccttcagggtttcaatcgcttctctgctcaagtctgcacacggcctccctnaccatctctggctccgagctagaagacgaggctgtattattacngcagctcatatacagcagcagcacttcgtaggtttccgggcgggaacgggtaccaaaggtccgtacggacccgttccgtaacgggttccaacggccccgaaagggcccttcccggccccccgttcggttaccccg

SEQ ID NO: 150740 - DNA, 517 bp, Homo sapiens
  misc_feature: GYAE6OF01ER40H.7.5.A05.1.454.CMB.1.raw
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgccttcagggtttccaatcgcttctctggctcagtctgcgacacgcctcccngaccatctctggctccagctgaagacgagntgattattactgcagctcatatacaggcagcagcactcgtacgggtttcggcgggtacgggaccgaagtcgtagaccgtccgtacggtcacgacccgaaggcctccggcccccgtcggtacccg

SEQ ID NO: 150741 - DNA, 527 bp, Homo sapiens
  misc_feature: GYAE6OF01ATEY4.7.5.A05.1.454.CMB.1.raw
  modified_base (412)..(412): a, c, t, g, unknown or other
  misc_feature (412)..(412): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctgctcaagtctggcgacacggcctccctgaccatctctggctccaggctgaagacgaggctagattattactgcngctcatatacaggcagcagcactctacgggtttcggacgggtacgggaaccgaagccgtcgacccgttccgtacggtccacggccccaagggcctcggtccccgttcggtacccg

SEQ ID NO: 150742 - DNA, 543 bp, Homo sapiens
  misc_feature: GYAE6OF01E33AS.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaatacccaggcaaagcccccaaagtcatcatttatgatgtctaataatcggtccttcaggggtttccaactcgtcttctctggcctccaagtcgtcggcgacacggccctccctcgaccatctcgtcgggcctccgaggcgtacgaacgacgaggctgactttattactgcagctacatatacgacggcagacagcacgtacgtagggtttcggcgggacgggaccaagctacgaccgtccgtagtcacgacccgaacggcctacgtcccccgtgtacccg

SEQ ID NO: 150743 - DNA, 563 bp, Homo sapiens
  misc_feature: GYAE6OF01D85FH.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctaggttaataaatntctctcctggtatcaacaactaccagacaaacgaccccaagtcatcatttatgatgtactataagtcgtccttcgtagggtttccaatcgtcttctctggctacaacgtctcggacgacgaccggcctccctgacctactctcgtggcctccgaggctagaacgacgagtctagtattattacgtgcacgtctacatactacgagcagacacgtactacgtcgtacgggtttcggacgggtacggaaccgacggtctacgtacccgtcggtacggtcacggtacccgaacggcctcccgtccccgtcggtaccc

SEQ ID NO: 150744 - DNA, 503 bp, Homo sapiens
  misc_feature: GYAE6OF01BHDAH.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctggctccaagtctggcacacggcctccctgaccatctctgggctccaggctgaagacgaggctgattattactgcagctcatatacaggcagcagcactctaggtttcggcggaggaccagctgaccgtcctaggtcacgcccaaggcctccgccccgtcggtccc

SEQ ID NO: 150745 - DNA, 679 bp, Homo sapiens
  misc_feature: GYAE6OF01DMB41.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggtctcaggaggcagcgctctcgggacgtctcccaccatggcctgggctctgctattcctcaccctcctcactcagggcacagggtcgtgggcccagtctgccctgactcagcctgcccttcgtgtctgggtctcctggacagtcgatcaccatctcctgcactggaaccacactgacgttgcttggttaataaatntctctccgtgtatcaaacaataacccgaggacaaacgccccaaagtccatctatttatgatgtactatatccggtccttcgtacgggtttaccaagtccgtcttctcgtcggtccttaccgaagttctgggccgaacgtaccggtccctcccgtgaacctctcttcgtcggtcctccgacggtctagaagacgtaggctagtactttaacttacgtagtactagtaccttactaattaactaacgacggtactacgtactaacggtaccttaccgttacggttaccgggttttaccggggaacgggtaaccgggttaacccggaaacggttccgtaaccgggttaccccgggttacgttaaccggggtcctaaacccggtaccccggaaacggtcccggttacccggtccccccgttcgggttaaccccg

SEQ ID NO: 150746 - DNA, 565 bp, Homo sapiens
  misc_feature: GYAE6OF01BVQNP.7.5.A05.1.454.CMB.1.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaactaccagacaaacgccccaaagtcatcatttangatgtctataatcgtccttgagggtttccaatcgcttctctgctacagtcnggcacgacggcctcctgaccctatcgtcgtgggcctaccgaggtctagaacgacggagtctgtatttagttactgactacgtctacaattactacgaggacagtacacgctacgtcgtagggtttcggacgggtacggaaccgtaagccgtacgacccggttccgtaggtaccacggtacccgtaacggtcccgtcccggtccccgtcggtacccg

SEQ ID NO: 150747 - DNA, 545 bp, Homo sapiens
  misc_feature: GYAE6OF01BF837.7.5.A05.1.454.CMB.1.raw
  modified_base (352)..(352): a, c, t, g, unknown or other
  misc_feature (352)..(352): n is a, c, g, or t
  modified_base (455)..(455): a, c, t, g, unknown or other
  misc_feature (455)..(455): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatatctctcctggtatcaacaatacccaggacaaacgccccaaagtcatcatttatgatgtctaataatcggccttcgagggtttccaatcgtcttctctgctcaagtcnggcacacggcctcctgaccctatcctacgtcggtctaccgacggcgtagaagaacggacggcgtagtattaacttaactgactagctatatatacagcagcancacgtacgtacggtttcggcgggaggaaccaacggcgtacgaccgtccgtacggtactacgaccgaacgcgtccgccccgtcggtacccg

SEQ ID NO: 150748 - DNA, 574 bp, Homo sapiens
  misc_feature: GYAE6OF01D1R5I.7.5.A05.1.454.CMB.1.raw
  modified_base (192)..(192): a, c, t, g, unknown or other
  misc_feature (192)..(192): n is a, c, g, or t
  modified_base (248)..(248): a, c, t, g, unknown or other
  misc_feature (248)..(248): n is a, c, g, or t
  modified_base (433)..(433): a, c, t, g, unknown or other
  misc_feature (433)..(433): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacngtcgatcaccatctcctgcactggaacccaccactgacgttgctggttaataaatntctctcctggtatcaacaatacccaggcaaagcccccaaagtcatctatttatgatgtctataatcgccttctagggttacaatcgcttctctgctcaagtctggtcgacacggcctccctgaccatctcgtcgggctccgaggctggaacgacgacggtctagatttagttactgctagacctntaatactacgaacgggcacggtcacggctacgtcgttacggggtttccgggacggggacgggaacccgaacggccgttacgacccggttctaacgggtcacggacccgaacgggtacctcccgtcccccgcggttaccccg

SEQ ID NO: 150749 - DNA, 630 bp, Homo sapiens
  misc_feature: GYAE6OF01AIHMG.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctaggttataatntctctctgtatcaacaactaccagacaaacgaccccaagtcactactatttatgtatgtactataacgtccggtccttcgacgggttaccatcgtcttctcgtgtcctacgtagtcgtcggcgtacgaccgtccctccgtacgaccctattccgtcgtcggtcctaccgacggtcgtaggaacggaccggtacggtacgttagtaacgtttactttacgtcgtacgtacgtctactaattacgtaaccgaggtacacgtcgacgtacctacgttacggttacgggtttccgggacgggtaacggtaaccgtacggtccgtacggtacccgtccggtacgtacgaccgtacccgacggccgtcccgtaccccgtcggttacccg

SEQ ID NO: 150750 - DNA, 539 bp, Homo sapiens
  misc_feature: GYAE6OF01DP4LE.7.5.A05.1.454.CMB.1.raw
  modified_base (379)..(379): a, c, t, g, unknown or other
  misc_feature (379)..(379): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgtttgcttggttaataaatatctctcctggtatcaacaatacccaggcaaacgccccaaagtcatcatttatgatgtctataatcggccttcaggggtttccaagtcgtcttctctggctcaagtctggcgacacggccctccctgaccntctcgtcggctccacggtctagaagacgaggctgattattctgcacgtctcatatacgaggcagacagcacgttcgtagggtttccgacgggtacggaccgaacgtcgtacgaccgtcgtaggtacacgacccgaacggccgtccgcccccgtcggtccc

SEQ ID NO: 150751 - DNA, 646 bp, Homo sapiens
  misc_feature: GYAE6OF01EOILT.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccagacaaacgccccaaagtcatctattatgatgtctatactcgcttctagggttcaatcgtcttctctgctcctaagtcgtcggcgacgccggtccctccctcgacctatcctacgtcggtcctccgaggtcgtacggaagacggaggcgtagttattacttacttgcacggtctactacttaagtacgaggaccacgtcaacggctaaccgttacggtttacgggtttaccggggacggggtaacggggtaacccgtaaacgggtccgttaaccgggtaccccggttacccgttaacggggtacccctaacccgggtaaccccggtaaacgggtccccgtaccccgggttcccccccgtcgggttaacccccggg

SEQ ID NO: 150752 - DNA, 766 bp, Homo sapiens
  misc_feature: GYAE6OF01CG4UX.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcacgtggaaaccaccactgacgttgcgttaggttaataaatntctctccgtggtatacaaacaactacccaggaccaaacgaccccctaaagtctaactactaatttatgtatgttactaattaacgtccggtacctttacggtacgggtttaccctaagtccgtcttccttcgtcggtcctaccgtaagtccgtaggaccgtaccgaaccggtccctacccgtacgaccctacgtccgtccgtacgggtcctaccgacggtacgtacggaaacggacggtaacggtaccgttaggttaactttaagtttaccgtacgtacgtactaccgtaactaacgttaacgttaaccgacgggtaccgacgaccgtaacggtaccgtaacccggtttaccggttaacggggtttaccggggaaccggggtaaacggggtaacccgaaacgggttaccgtaccgggtaaccccggttccggtaaaccgggttcccgaaaccggtacccccgggtaacgggtaccccgttccccgggtaccccccggttccggttaacccccg

SEQ ID NO: 150753 - DNA, 509 bp, Homo sapiens
  misc_feature: GYAE6OF01E1ZIJ.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaaatatctctcctggtatcaacaatacccaggcaaagcccccaaagtcatcatttatgatgtctataatcggcttcagggtttccaatcgcttctctggctccaagtctggcgacacggcctccctgaccatctctgggactccagctgaagtacgaggctgattattactgcagctcatatacaggcagcagctactcgaggtttcggacggtagggaccaaggctaggaccgtccaggtcagcccaaggcctcgtccccctggtcc

SEQ ID NO: 150754 - DNA, 574 bp, Homo sapiens
  misc_feature: GYAE6OF01EAUN5.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggacaaacgcccccaaagtcatctatttatgatgtactataactcggtccttcgtaggggtttccaatcgtcttctctcggctaccaagtctggccgaccgaccggccctcccgtcgaccctagtccttcgtcgggaccttccgaggctaggaagacgaggtctgtatttattactgcagtctacatatacgagcagcagcactcgtagggttttcgggacggacgggaccgaacgtcgtacggacccgttccgtacggtacgaccgtcccgaacggtcctcccggcccccgtcggtaccc

SEQ ID NO: 150755 - DNA, 671 bp, Homo sapiens
  misc_feature: GYAE6OF01EH898.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactggaaccaccactgacgttgcttggttaataaatatctctcctgtatcaaacaataccaggacaaacgccccaaagtcatctatttatgtatgttactaataagtccggtccttcgtacgggtttccaatccgtcttctcgtcggcctcaagtcgtcggccgacgtacggtccctcccgtacgaccctagttccgttcggtcgggtccctccgagggtcgtacggaaaggaccggtaggtaccgtagtaacgtttaacttacgtacgtcctaagtctaccgtaataacgtacgagggaccacggtacctacgcctacgttaccggttaacgggtttccggggaccgggtacgggtaaacccgtaacgggtcgtaccggtacccgttacccggtacggtacccgacccgggtaccccgaagggtccccttcccgggcccccgttccgggttaccccg

SEQ ID NO: 150756 - DNA, 508 bp, Homo sapiens
  misc_feature: GYAE6OF01CHL8Z.7.5.A05.1.454.CMB.1.raw
  modified_base (330)..(330): a, c, t, g, unknown or other
  misc_feature (330)..(330): n is a, c, g, or t
  modified_base (495)..(495): a, c, t, g, unknown or other
  misc_feature (495)..(495): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatatctctcctggtatcaacaatacccaggcaaacgccccaaagtcatcatttatgatgtactataatcgccttcagggtttcaatcncttctctggctccaagtctggcgacacggccctccctgaccatctctggcctcgacggctgaagacgaggctgatttacttactgcagctcatatacaggcagcagccatcgtaggtttcggcggtaggaccaagctcgaccgtccgtaggcacgcccgaaggcncgccccgtgtacc

SEQ ID NO: 150757 - DNA, 548 bp, Homo sapiens
  misc_feature: GYAE6OF01CCB0Q.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctaggttaataatatctctcctggtatcaacaatacccaggcaaacgcccccaaagtcatctatttatgatgtctataatcgtcttcgtagggtttccaatcgtcttctctggctcaagtctggcgacacgcctcctgacctatctctcgggtcctccgacggtctaggaagacggaggctagtattacgttactgcagtctactatatacgaggcagcagctacgtcgtacgggtttcggacgggtacggaaccgtagcgtacgtaccggtccgtacggtcgacgacccgaagtccctccgcccccgtgtacccg

SEQ ID NO: 150758 - DNA, 545 bp, Homo sapiens
  misc_feature: GYAE6OF01DLXFZ.7.5.A05.1.454.CMB.1.raw
  modified_base (427)..(427): a, c, t, g, unknown or other
  misc_feature (427)..(427): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgtcctgactcagcctgcctccgtgtctgggtctcctggacagtcgatcaccatctcctgcactggaacccaccactgacgttgcttggttataaatatctctcctggtatcaacaatacccagacaaacgaccccaaagtcatactatttatgatgtactataatcggtccttcgtaggggtttccaatcgcttctctcggctccaagtctggcgcacggcctccctgaccatctcgtcggtctccgaggctagaagacggaggctgtattattacngcagtctctatatacgagtcagcagcacgtcgtacgggtttcggacggtagggaccaaggcgtacggaccgttccgtacggtcgaccgccgaacggccgtccgccccgtcgggtaccc

SEQ ID NO: 150759 - DNA, 563 bp, Homo sapiens
  misc_feature: GYAE6OF01CCXEU.7.5.A05.1.454.CMB.1.raw
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaaccacactgacgttgctggttataaatntctctcctgtatcaacaatacccaggcaaagcccccaaagtcatcatttatgtatgtctaatatacggccttcgagggtttccaatcncttctctggctcaacgtctggcacacggcctccctgacctatcctactcgggtctccgaggctagaaagacgaggctgtattattaacgtgcagtctntactaatacgtacggctaagcacgtcaaccgttntaacgggttttcggacgggacggtaccgaacgtctacggaaccggttccgtaacgggtcaacggtcccgaaggtccctccggccccgtcggtacccg

SEQ ID NO: 150760 - DNA, 570 bp, Homo sapiens
  misc_feature: GYAE6OF01D4VZE.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctgtatcaacaatacccaggcaaacgccccaaagtcatcatttatgatgtctataatcgtccttcagggtttccaatcgcttctctggctcaagtctggcgacacggccctccctcgaccatctctcgggcctccgagctaggaagacgaggctgtattattactgcagctcatatacgacgcgacgcgacgcgtactacgttagggtttccgggtacgggacggggaacccggaacgacggtaccgaccggttacccgtacggtaccgtaccggacccgaacggtccgtacccggtcccccgtcccggttaccccg

SEQ ID NO: 150761 - DNA, 542 bp, Homo sapiens
  misc_feature: GYAE6OF01C1M0G.7.5.A05.1.454.CMB.1.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
tcagcgtgtctctacacgaccggtgctcgatttagatagatagacaggggggggtctcaggaggcagtgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccaccactgacgttgcttggttaataaatntctctcctggtatcaacaataccaggcaaacgccccaaagtcatcattangatgtctataatcgccttcagggtttcaatcgcttctctgctcaagtctcggcgacaccggcctcctgaccatctcgtcggcctccgacggctggaagacgaggctgtattattactgctagctacaatactaacgaggtacacgtcagcctacgtcgtagggttttcggacgggtaacgggaccaagtccgtcgtaccgtcgtacggtcgacgtcccgaacggcctacgcccccgtgtaccccg

SEQ ID NO: 150762 - DNA, 846 bp, Homo sapiens
  misc_feature: GYAE6OF01ATSUD.7.5.A05.1.454.CMB.1.raw
  modified_base (315)..(315): a, c, t, g, unknown or other
  misc_feature (315)..(315): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctggtctcctggacagtcgatcaccatcctcctgcactcggaacccaccactgaccgttgcttaggttaataaattactcctcttccgtggtatacaacaactacccaggaccaaacgcccccaaagtcaatctatttangtattgtactataacgtcggtccttacgtaggggtttacccaagttccgtcctttaccgttcgtacgggtccttacccgtaacgttcgttacgggaccgtaccgacccggtcccctaccccgtcgtacccacgtttccgttccgtcgggtccctacccggtacggtaccgtacgggtaaaccggacggtaacgggtaccgttacggttaatttaacgtttaccgttacgtaccgtaacgtacccgttactaaacgttaacgtaaccgtaacgggtaccgaacggtaccgtaaccgtacccgttaacccggtttacggtttaccgggggtttttaaccggggaacccgggggtaaacccggggtaaacccgggtaaacccgggtccggtttaacccggggttaacccccgggtttaacccgggtttaacccggggtacccggtaaacccggggtaacccccgggtaaccggggttacccccggtttccccccgggttaaaccccccgggttccccgggtttaacccccccgg

SEQ ID NO: 150763 - DNA, 746 bp, Homo sapiens
  misc_feature: GYAE6OF01DUQ4Y.7.5.A05.1.454.CMB.1.raw
  modified_base (133)..(133): a, c, t, g, unknown or other
  misc_feature (133)..(133): n is a, c, g, or t
  modified_base (248)..(248): a, c, t, g, unknown or other
  misc_feature (248)..(248): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacngggtcgtgggcccagtctgccctgactcagcctgcctccgtgtctgggtctcctggacagtcgatcaccatctcctgcactggaaccacactgacgttgcttaggttaataaatntcttctcctggtatacaacaactaccagacaaacgaccccaaagtcatctatttatgatgtactataactcgtccttacgtacgggtttaccaagtcgtcttctctgctacagtctcggcgacgccggtccctcccgtacgacctacttccgtccgtcgggacccttaccgacggtacgttagggaaacggtacgggaacggtacgttagtaacttttaacgtttacgtcggtacctaacgtccttaactaacgttaacgtaaccgtaacgggaccaacggtaccaacggtaccttaaccggtttaccgggtttaaccgggggttttcccgggaaccgggggtaaaccggggtaaaccccgtaaacgggtcccggtttaacccgggttaaccccggttaccgggttaaccgggttacccggaaacccgggtaacccccggtaacgggttacccccggttaccccggttaccccccccggttccggggtttaaaccccc

SEQ ID NO: 150764 - DNA, 597 bp, Homo sapiens
  misc_feature: GYAE6OF01B38DH.7.5.A05.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccnccatgacgttnctggttataaatntctctctgtatcaacaatacccaggacaaacgccccaaagtcatcatttatgattgtctataatcgtcttcgtagggttcatcgtcttctctgctctagtctgcacacgcctccngacctatcgtctcgggctccgaggctagaacgacgaaggctagtacttagttaactcgacgacgtcttcaacttaagttaaccgacggtacgacgtaccgacggtacctaccgttacgtaaccggggttttcgggaacccgggagggtaacccaaggtcccgttcggaacccggttccctagggtacccacggtaccccgtaaggtacccgtcccggtacccccgttcgggtacccc

SEQ ID NO: 150765 - DNA, 620 bp, Homo sapiens
  misc_feature: GYAE6OF01C05NW.7.5.A05.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
  modified_base (601)..(601): a, c, t, g, unknown or other
  misc_feature (601)..(601): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccntctcctgcacgtggaacccacactgacgttgcgttagttaataaatctcttctccgtgtatacaaactaactacccaggacaaacgacccccaaagtcatactactttatgtatntactaatactcgtcttacgtacgggtttccaagtcgtcttctcgtcgcctacaagtcgtcggacgaccgaccggcctccctcgacctactcctcgtcggcctcgacggtctaggaacgacggaggtcttaggtaatttacgttagtcgacgtacgtctactatacgtacgaacggacacgtcaacgcgtacgttacggttacgggtttccggacgggaaccggtaaccgaacggtccgtacggtaccggtcggtacggtccgaaccgtccgaacggtcccncccgtcccccgtcggtccc

SEQ ID NO: 150766 - DNA, 542 bp, Homo sapiens
  misc_feature: GYAE6OF01AMWIQ.7.5.A05.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (315)..(315): a, c, t, g, unknown or other
  misc_feature (315)..(315): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccncactgacgttgctggttataaatntctctcctggtatcaacaatacccaggcaaagcccccaaagtcatcatttatgatgtctatatcgccttnaggggtttccaatcgcttctctggctcaagtctcggcacacggcctccctgacccatctcgtcggctccaggctagagacgaggctgattattactgcagctcatactacagcagcagctactcgtacggtttcggacgggtacgggaaccgaaggtccgtacggacccgttccgtacggtaccgacgtacccgaacggtccctaccggcccccgtcggttaccccg

SEQ ID NO: 150767 - DNA, 602 bp, Homo sapiens
  misc_feature: GYAE6OF01C6KD1.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctgtatacaacaactacccaggacaaacgaccccaaagtcatctatttatgtatgtactaataatccggtacctttcgtacgggtttccaagtcgtcttctctggcctccaagtctggcacgacggccctccgtcgacctactctcgtcgggtcctccgaggtctaggaacgacggagacttgtactttattacgtgacacgtctactaattaactaacgaggtacagcacgactacgtcggttagggtttccgggacgggaacggaaccgacggtcgttacggacccggttccgtaggtacccgaaccggacccgaacgggtccctacccgtcccccgtcggtaccc

SEQ ID NO: 150768 - DNA, 539 bp, Homo sapiens
  misc_feature: GYAE6OF01CL644.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttaataaatatctctcctggtatcaacaatacccaggcaaaacgcccccaaagtcatcatttatgatgtctataatcggccttcaggggtttccaatcgcttctctggctccaagtctcggcgacaccggccctccctgacccatctctgggctccaggctgaagacgagctgtattaattactgcagctcatatacaggcagcagcactcgtaaggttttcgggcggacgggaccaaaggtccgtaggacccggttccgtacggtccacgcccgaaggcctcccggccccctcgggtccc

SEQ ID NO: 150769 - DNA, 683 bp, Homo sapiens
  misc_feature: GYAE6OF01A7Z6D.7.5.A05.1.454.CMB.1.raw
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccagcaaagcccccaaagtcatcatttatgattgtctataatcggccttctaggggtttccaatcgtcttctctggctccaagtctcggcgacaccggtcctccctcgacctatcttaccgtgggtcctccgacggtaccgtacggtaaacggaccgggaacgggtccgttaggtaacttttaacgtttaccgtacggtaccgtaacggtccttacgtaacttaacgttaacgtaacgggaccaacgggtaccaacggtacctacccttacggtaacggggtttttaccgggacggggtaaccgggaccgaaacggtccgttaccggaccccggtttaaccgtaaccgggttccgaaaccgggtaccccgaacgggtacccgttccccggaccccccgttcgggttaacccccg

SEQ ID NO: 150770 - DNA, 520 bp, Homo sapiens
  misc_feature: GYAE6OF01BE2D5.7.5.A05.1.454.CMB.1.raw
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatatctctctggtatcaacaatacccaggcaaagcccccaaagtcatcatttatgatgtctataatcggcttcagggtttccaatcgtcttctctggtctccaagtctggtcgacaccgcctccctgacccatcctcgtcgggctccgaggctgaagacgaggctagtattatactgcagctnatntaacaggcagcagcacgtgtacggtttggcggagggacctaagcgtagaccggttcgacggtcacgcccaaggcctaccgccccgtggtcccg

SEQ ID NO: 150771 - DNA, 543 bp, Homo sapiens
  misc_feature: GYAE6OF01CLT2Y.7.5.A05.1.454.CMB.1.raw
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataatatctctcctggtactcaaacaatacccaggacaaaacgccccaaagtcatactatttatgatgtactataatcggtcctttacgtagggtttccaatcgtcttctctggctacgaagtctggcacacggcctcccngacatctcgtggctcgngcagaagacgagctagattatactgacagctacatatacaggcagtcacgcacgtcgtaaggtttcgggaggacgggaccgaagcgtcgtaccgtcgtacggtccgaacgtcccgaacggcctaccgtcccccgtcggtacccg

SEQ ID NO: 150772 - DNA, 657 bp, Homo sapiens
  misc_feature: GYAE6OF01D5WQK.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtcgtggtctccgtggacagtcgatcaccatcctcctgcacgtcggaacccaccactgacgttgcttagttaataaatntctctcctgtatcaacaataccagacaaacgcccccaaagtcatctatttatgtattgtactattaacgtccggtcctttacgtacgggtttaccaagttcgtcttctctggtctacctagtcgtcggcgaccgaccgtccctccctcgacctattccgtcgtcggcctccgacggtcgtagaacggacggacgtacttagtatttaactttacgtcgtacgtacgtctactaataactacgacggacgtacgccgtacgacctacgttacggttacggggttttccgggacggggtaacggaaccgtaacggtcgtaccgggtacccggttacccgttacggtacccgtaaccgtacccggtaaccggtacccgtccccggtcccccgttccgggttacccc

SEQ ID NO: 150773 - DNA, 656 bp, Homo sapiens
  misc_feature: GYAE6OF01D96YI.7.5.A05.1.454.CMB.1.raw
  modified_base (252)..(252): a, c, t, g, unknown or other
  misc_feature (252)..(252): n is a, c, g, or t
  modified_base (312)..(312): a, c, t, g, unknown or other
  misc_feature (312)..(312): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttgcttaggttaataaatntctctcctggtatacaaacaactaacccaggacaaaccgaccccaaagtcatactaattntgtatgtactataagtcgtaccttcgtagggtttaccaagtcgtcttctcgtcgctaccgaagtcgtacggccgacgtaccggtccctcccgtagaccctacgtccgttccgtcgggtcctaccgtacgggtactagggtaacggacggacgtacgtagtaatttacgtacgttcgacctaggtctacgtactaacgtacgacgacgacggactagtcctaacgttccgtacggggtttcggaccgggtaacggaccgaacggtaccgtacgtacccggtaccggttacggacccgtaccgggacccgtaaccggtcccgtacccgtcccccgtgtacccccgg

SEQ ID NO: 150774 - DNA, 525 bp, Homo sapiens
  misc_feature: GYAE6OF01B5UZS.7.5.A05.1.454.CMB.1.raw
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggacaaacgcccccaaagtcatcatttangatgtctataatcggccttcgagggtttccaatcgcttctctggctcaagtctggcgacacgcctccctgaccatctcgtcggctccgaggctagaagacgaggctagatttacttactcgcagtctactatactacgacggacagacagcactcgtaggtttcggcggacggaccgagtctacgaccgttcgacgtcacgccgaagcctccgccccgtcgtccc

SEQ ID NO: 150775 - DNA, 809 bp, Homo sapiens
  misc_feature: GYAE6OF01BPJES.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactgaaccaccactgacgttgctgttaataaatatctctctgtatcaacaatacccaggacaaacgaccccaaagtcatactatttatgtatgttctaataacgttcggtccttacgtacggggttttccaaagttccgtctttctcgtcggtactaccctaacgttcgtacgggtccgaaccgtacccgggacccttccccgtacgaccctacttccgttccgtcggggtcccttcccgaacgggtccttaacgggaaacggaaccggtaacgggtaccgttaggtaacgttttaaactttaccggttacgaccgtaaggtacccttacctaaagtttaacgtaaaccgtaacgggtaacccgaacgggaccgtaacggtaaccccttaaccgttaccgggtttaacggggtttttaccccggggggaaccggggtaaacccgggggtaaacccgtaaacgggtaccgggttacccggtaaccccccggggtttacccgggttaaaccgggtccccgtaaaaccgggtacccccggtaaaaccgggtcccccgttacccccgggttacccccccccggtaccggggtttaccccccg

SEQ ID NO: 150776 - DNA, 631 bp, Homo sapiens
  misc_feature: GYAE6OF01EGO2A.7.5.A05.1.454.CMB.1.raw
  modified_base (252)..(252): a, c, t, g, unknown or other
  misc_feature (252)..(252): n is a, c, g, or t
  modified_base (487)..(487): a, c, t, g, unknown or other
  misc_feature (487)..(487): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaaccaccactgacgttgcttagttaataaatntctctctgtatcaactaactaccaggacaaacgaccccaaagtcatctaatttatagtatgtctaataagtccggtcttcgtaacgggtttccaacgttcgtcttctcgtggtactacaagttcgtggccgtaccgaccggtccctccgtacgacctacttccgtcgtcgggtcctccgacggtcaggtacgaacggacgtctagtaatttatactcgtacacgtctacattaanacgtagacgtaacgcacgtctacgtgttaagggtttccggaacgggtacggaaaccgtaggtcgtaccggtaccggttaaccgtacggtaccgaccggaccccggtaacggtcccgtacccggtcccccggtacggttaccccg

SEQ ID NO: 150777 - DNA, 554 bp, Homo sapiens
  misc_feature: GYAE6OF01A5WN3.7.5.A05.1.454.CMB.1.raw
tcagcgtgtctctacacgaccggtgctcgatttagatagatagacagggggggtctcaggaggcagcgcctcgtcgggacgtctccaccatggcctgggctctgctattcctcaccctccttcactcagggcacagggtcgtgggcccagtctgccctggactcagcctgcctccgtgtctagggtctcctggacagtcgatcaccatcctcctgcacttggaaccaccactcgaccgtttgccttaggttaactaaattatctactcctggtatcaacaactacccaggacaaacgcccccaaagtcatcgattatgatgtctatatcgcttcagggtttccaatcgcttctcgtcgctcaagtctggcgacgacggcctcctcgacactctctcggctccagctgaagacgagtcgagtactattactcgcgtatactcatatacaggtcacgtacacgtacactctagggtttacggccggagggaccaacggcgtacgaccggtccgtacggtcacgtacccgaacgtccgtcgtccccgtcggtacccg

SEQ ID NO: 150778 - DNA, 617 bp, Homo sapiens
  misc_feature: GYAE6OF01AHGC6.7.5.A05.1.454.CMB.1.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
  modified_base (448)..(448): a, c, t, g, unknown or other
  misc_feature (448)..(448): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctctggacagtcgatcaccntctcctgcactcggaaccaccactgacgttgcttggttaataaatctctctcctggtatcaacaataccagacaaacgccccaaagtcatctatttatgatgtctatatcgtcttcgtacgggttcatctcttctctggcctcaacgtcgtcggcgacnccggtaccctcccgtacgacctatcttcgtcgggtcctccgtacggcttaggaacgacgtacgggtcttaggtactttacgtttacgngtactacgcttacgtacttaacgtacgaacggtcgaacgccgacgtaccgtacgttacggtaccgggttttacgggcggggtaacggtaaccggtaacggtccgtacggtacccggttcgtacggtccgacggacccgacggtcccgtccggcccccgtcggttacccg

SEQ ID NO: 150779 - DNA, 554 bp, Homo sapiens
  misc_feature: GYAE6OF01B7WT8.7.5.A05.1.454.CMB.1.raw
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccacactgacgttgctggttataaatatctctcctggtatacaacaatacccaggacaaacggtcccccaaagtcatacatttatgatgtctataatcgcttcgagggtttcaatcgcttctctgctacaagtctcggcgacacggcctcctgaccatctctcgggctcacggtcgtagaagacgaggtctgtaattacttacgtgcgacgtctactaatacttaacgacggctacgacacgtcacgtcgttaacggtttcgggacggacgggacacggcgtacgacgtccgtacgtcgaaccgccgaaacggcctaccggtccccgcgttaacccg

SEQ ID NO: 150780 - DNA, 567 bp, Homo sapiens
  misc_feature: GYAE6OF01BDTL6.7.5.A05.1.454.CMB.1.raw
  modified_base (242)..(242): a, c, t, g, unknown or other
  misc_feature (242)..(242): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcacatctcctgcactggaaccacactgacgttgctggtataatntctctctgtatacaacaactaccagacaaacgccccaaagtcatctatttatgatgtactataactcgtcttcgtagggtttccaatcgtcttctcgtcgtcctcaacgttctcggacgacgaccggccctcccgtacgacctatctcgtcggcctccgagctagaagacgagctagtatttattactgacagtctacaatactacgagacagcagtctacgtcgtacgggtttcggacgggtacggaaccgagtccgtacgtacccggttcgtaggtcccgacggacccgtaacggtaccctcccggcccccgttcggtacccg

SEQ ID NO: 150781 - DNA, 671 bp, Homo sapiens
  misc_feature: GYAE6OF01EU169.7.5.A05.1.454.CMB.1.raw
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttanagtnatagtactactaactcggtccgttactacgggttcctacttcgtcttctctcgtactcctagtctcggcgacctaccgcctaccctcgtacctacnttccgtcgtcggtcgtaccgacggacgtacgtanacggaacggtacggtacgttagtacgtttaacgttaacttacgtactacgtaccgtaacctaacgtaacgtaaccgaacggtaccgtaacggtaccgaacggttaccgtaaccggtttaccgggtaccgggtttaccggggtaccgggtaacggggaacccggtaaacggtaccggtaccggtacccggtacccggtaacgggtacccgtaaccggtaccccggtaaccgggtaccccg

SEQ ID NO: 150782 - DNA, 562 bp, Homo sapiens
  misc_feature: GYAE6OF01CB6UV.7.5.A05.1.454.CMB.1.raw
  modified_base (428)..(428): a, c, t, g, unknown or other
  misc_feature (428)..(428): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgccttcgtagggtttccaatcgcttctctgctccaagtctggcgacacggcctccctgaccatctctggctccaggctagaagacgaggctagtattattactcgctagctacatanacgagcagcagcactcgtacggttttcgggacgggtacgggaaccaacggtccgtacggtaacccggttcccgttaacgggtaccgaacggtaccccgaacggtaccgtcccggtccccccgtcggttaccccg

SEQ ID NO: 150783 - DNA, 835 bp, Homo sapiens
  misc_feature: GYAE6OF01A2FJ6.7.5.A05.1.454.CMB.1.raw
  modified_base (259)..(259): a, c, t, g, unknown or other
  misc_feature (259)..(259): n is a, c, g, or t
tcagcgtgtctctacacgaccggtgctcgatttagatagatagacgtagggggggggtctcaggacggcagcggctcctcgggacgttctccaccatggcctgggctctgctattcctcaccctcctcactcagggcacagggtcgtgggccctagtctgccctgactcagcctgcctccgtgtctgggtctccgtggacagtcgagtcaccatctcctggcacgtggaaccaccactgacgttgcttggttataaatnttctctctggtatcaacactaccgaggaccaaacgcccccaaagtccaacgtcatttagtgtattcgtacttaataacgtaccggtccttcgtaacggggtttaccaaagttcgtacttccttcgtcggcctacccgtaagtacgtacgggaccgtaaccgacccggtccccttaccccgtacgtaacctacgttaccgttaccggttaccggggaccctttcccggtaacggggttaccgttacgggaaaacggtaacgggtaacgggtaaccgtttacgggttaactttttaaaccgtttaaaccgtcggtacccgtaaccggtaccttacctaaacgtttaacgttaaccggaacggggtaacccaacgggtaccgtaacggttaccctaaccgggtttaccggttaacgggggttttacccggggaaccggggtaaaccggggtaacccggtaacgggtacccggttacgggttacccccggtttaccggttaacgggtacccgtaaccgggtacccccgggtaaacgggtcccccggtccccgggttaccccccgttcgggttaacccccg

SEQ ID NO: 150784 - DNA, 566 bp, Homo sapiens
  misc_feature: GYAE6OF01C9JS6.7.5.A05.1.454.CMB.1.raw
  modified_base (298)..(298): a, c, t, g, unknown or other
  misc_feature (298)..(298): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaacccaccactgacgttgcttggttaataatatctctcctgtatcaacaatacccaggcaaacgccccaaagtcatcatttangatgtctataatcggtccttcgtaggggtttccaatcgtcttctctggctacaagtctggccgacaccggccctccctcgacctatctcgtcgggcctcccgaggctaggaaagacggaggtactggtatttattacgtgcagtctacattaactaacgaggtcagtcagcacgttcgtagggtttccgggcggacgggaccaaggtcgtcggtacccgtccgtacggtccacggacccaaggccctccggtcccccgtcggtacccg

SEQ ID NO: 150785 - DNA, 588 bp, Homo sapiens
  misc_feature: GYAE6OF01BFQ7U.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttataaatatctctcctggtatacaacaataccagacaaacgccccaaagtcatcatttatgatgtactatatcggtcttcgagggtttccaatcgtctctctgctcaagtctggcacgcgccctcctcgacctatccgtcgtcggcctaccgaggtctaggaagacggagcgtagtactttattacgtgacgagtactactattacacgacggacacgtacagaccgtacgttcgttaaccgggtttcgggaccgggacggggtaacctaaggtccgtaccggtacccggttccgtaccggtacccggacgtaccccgaggacccttcccggcccccgttgggtacccc

SEQ ID NO: 150786 - DNA, 599 bp, Homo sapiens
  misc_feature: GYAE6OF01CDLWV.7.5.A05.1.454.CMB.1.raw
  modified_base (246)..(246): a, c, t, g, unknown or other
  misc_feature (246)..(246): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaactacccaggcaaacgccccaaagtcatcatttatgatgtctataactcggtccttcgagggtttccaatcgtcttctctggctcagtctggcgacacggtcctccctgaccattcctcgtcggcctccgacggtctaggaacggacggacggtcgtagtaactttaacgtttacgtcgacgacgtcctataactataacgaggacagtccacgtctacgttccggtacgggttttccgggacgggtaacgggtaacccgaaggtccgtacggacccggttccgtacgggtacaccggtacccgacggtccgtcccggtcccccgtcggtacccc

SEQ ID NO: 150787 - DNA, 593 bp, Homo sapiens
  misc_feature: GYAE6OF01DUETO.7.5.A05.1.454.CMB.1.raw
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatcctcctgcactggaacccaccactgacgttgctggttaataatatctctcctggtatcaacaatacccaggacaaacgccccaaagtcatcatttatgatgtctaataactcggtccttacgtagggtttaccaatcgtcttctcgtggactcaagtcnggcgacgacggcctccngacctagtctcgtcggtctcgaggtctaggaagacgacggacttagtatttacttacgtcgacgacgtctactaagtaacgtacgaggacacgacagcctacgttacggtacgggtttacgggacggaacgggaacgtacggtcgtacggtaccgtccgtacgggtccaacggacccgtaacggtcccgttcccggtcccccgtggtaccccg

SEQ ID NO: 150788 - DNA, 632 bp, Homo sapiens
  misc_feature: GYAE6OF01BXIUI.7.5.A05.1.454.CMB.1.raw
  modified_base (357)..(357): a, c, t, g, unknown or other
  misc_feature (357)..(357): n is a, c, g, or t
tcagcgtgtctctacacgaccggtgctcgatttagatagatagacaggggggggtctcaggaggcagcgctctcgggacgtccccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgcttggttataatatctctcctggtactacaacaatacccaggacaaacgacccccaaagtcatcatttatgatgtctataacgtcggtcttcgtagggttccaatcgtcttctctggctcagtcngcacacgctcctcgacatctcgtcggctccgaggctaggaacgagaggtcgtgtatttattactgactagctacctatacgtaacgacggtacaagaccacggacctaacgttaccggttacgggggttttaccggaccgggggtaacggggtacccgaaacgggtccgttaaccgggtaccccgtttaccgggttaccgggtaccgaaacccgggtacccggtaaaccgggtcccgttaccccggtccccccggttacggtccccgttaccccg

SEQ ID NO: 150789 - DNA, 688 bp, Homo sapiens
  misc_feature: GYAE6OF01BM275.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaatacccaggcaaagcccccaaagtcatctatttatgatgtactataatcggtccttgtacggggtttccaatcgtacttctctggtctccaagtctggcacgaccggccctccctgacccattcctacgtcgggcctccgacgggtcgtacggaacggaacgacgggtcttaggtaatttaacgtttacgtcgtacgtacggtccttacaacttaataacgacgggacaacggtaccgaacgtaccgtacgttaccgttacggggtttttacccggggacggggtaaaccggggtaaacccggtaacgggtcccggttacgggtaacccccggttacccggttaaccgggttaccgaaacccgggtaccccgtaaacgggtaccccgttaccccggcccccccggttaacccgggttacccc

SEQ ID NO: 150790 - DNA, 597 bp, Homo sapiens
  misc_feature: GYAE6OF01AB51Z.7.5.A05.1.454.CMB.1.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccagcaaagcccccaaagtcatcatttangatgtctataactcggccttcgagggtttccaatcgcttctctggcctccaagtctggcgacaccggccctcccgtgacccatcctcgtcgggtcctccgacggtacgtacggaaggtaccggacgggcttagtactttacttacgtcgtacacgccttacaattacacgacggtcgagacgacgctacgtacgtacgggttttccgggacgggtaccgggaccgaaggtccgtacggacccggtcgttacggtccgaacgtccccgtaacggcccgtccgtcccccggtcggttacccg

SEQ ID NO: 150791 - DNA, 540 bp, Homo sapiens
  misc_feature: GYAE6OF01BHN6W.7.5.A05.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (376)..(376): a, c, t, g, unknown or other
  misc_feature (376)..(376): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccnccactgacgttgctggttataatntctctcctggtatcaacaataccaggcaaacgccccaaagtcatctatttatgatgtctatatcgcttgtagggttcatcgctctctgctcagtctggcgacacggtcctcctgaccatctctggctcgnggctaggaacgacgaggctagtattacttacgtgctagctacgatactacgaggtacagtcagtctacgtcgtagggtttcggacgggtaggaaccgaagtcgtacgtaccggttcgtacggtccgacggtacccgacggtacctccgtcccccgtgggtcccc

SEQ ID NO: 150792 - DNA, 651 bp, Homo sapiens
  misc_feature: GYAE6OF01DR4XV.7.5.A05.1.454.CMB.1.raw
  modified_base (250)..(250): a, c, t, g, unknown or other
  misc_feature (250)..(250): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtggcccagtctgccctgactcagcctgcctccgtgtctgggtctccgtggacagtcgatcaccatctcctgcactggaacccaccactgacgttgcttggttaataaatntctctcctggtatcaacaactacccaggacaaacgcccccaaagtcatcatttatgatgtctataatcgcttctagggttcaatcgcttctctgctacaagtctgcgacacggcctccctcgaccatctcgtcggcctccgacggctagaacgacggacggtcgtagtatttacttaccgtgtactacgtactacgtaactaactacgtaacgggaccaacggtccgtaacggtaccgtaaccgttccggttaacggggtttttacccggggacgggtaacggggaacccgtaacgggtacccggttaaccggtacccggttacccggttaaccggtaccggtaacccggtaccccgtaaacggtcccgtaccccggtccccccgttcgggttaacccccg

SEQ ID NO: 150793 - DNA, 688 bp, Homo sapiens
  misc_feature: GYAE6OF01D3CHS.7.5.A05.1.454.CMB.1.raw
  modified_base (250)..(250): a, c, t, g, unknown or other
  misc_feature (250)..(250): n is a, c, g, or t
  modified_base (502)..(502): a, c, t, g, unknown or other
  misc_feature (502)..(502): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcaggcacagggtcgtgggcccagtctgccctgactcagcctgcctcgtgtctgggtctcgtggacagtcgatcaccatcctcctgcactacggaaccacactgacgttgcttaggttaataaatntcctctcctggtactacaacaatacccagaccaacgacccctaaagtcaatctatttactgtatgttactaattaacgtcggtcctttcgtacgggtttaccaacgttcgtacttctcgtcgtctaccgtaacgttcgtcggaccgaccgaccggtccccgtcctcgaaccctacttccgttcgtcgggtcctaccgacggtcgtagtaaacggaccgtacggtacttaggttaacttttacgtttaaccgngtacctaggtccttactaattaacgtaccgaacggtcaacggtactaccgaccgtacgttaccgggtacggttttaccggggacgggtacgggaacctacggtccgtacgggtaaccccgttcggtaccggtacgaaccgtacccggacggttacccgtcccggtccccgttccggttaaccccgg

SEQ ID NO: 150794 - DNA, 561 bp, Homo sapiens
  misc_feature: GYAE6OF01CDEBT.7.5.A05.1.454.CMB.1.raw
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatntctctcctggtatcaacaactaccaggacaaacgccccaaagtcatcatttatgatgtctataatcgcttnagggtttccaatcgcttctctcggctcagtctcggcgacacggcctcctgaccattctcgtcggtcctccgaggcgtagaagacggaggcttagtatttattacgtcgcagtctctaatactaacgagtacacgcagctactcgtacggtttccggacgggtaacgggaaccaacggtcgtacggaacccgttcggtacggtacgacggtacccgacggcccgtccggcccccgtcgggtaccc

SEQ ID NO: 150795 - DNA, 640 bp, Homo sapiens
  misc_feature: GYAE6OF01BNHO0.7.5.A05.1.454.CMB.1.raw
  modified_base (252)..(252): a, c, t, g, unknown or other
  misc_feature (252)..(252): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactacggaaccaccacgtgacgttgcttgttaataaatntctctctgtatacaacaactacccaggaccaaacgaccccaaagtcatactatttatgatgtactatacgtccgtcttcgtacgggttacaatcgtcttctcgtcgctaccgtaagtcgtacggacgaccgaccggtccctacccgtgaaccctacttccgtcgtcgggtccgtacccgtaggtaccgtaggaaacgacggaggtacgttagtatttaacttacgtcgtacgacgtctactaatataacgacggacacgacgacgtacaccgttacggtagggtttaccgggacgggtacgggaaccgacgtccggtacgtacccggtacgtaccggtaccgaccggacccgtaacgggtccctcccggtcccccgtcggttaccccg

SEQ ID NO: 150796 - DNA, 697 bp, Homo sapiens
  misc_feature: GYAE6OF01BJUN7.7.5.A05.1.454.CMB.1.raw
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctccgtggacagtcgatcaccatcctcctgcacgtacggaaccaccacgtgacgttgctaggttaataaatntctctccgtggtatacaacaataccaggaccaaacgccccaaagtcatactatttangtatgtactataactcggtccttacgtacggggttaccaagttccgtctttcgtacgtggacctacgtaacgtccgtacggccgtaaccgtaccgggtccctcccgtacgaaccctacgttccgtccgtcgggtcctaccggtacggcgttacggaaacgggacgaagggtccgttaggtaactttaagtaccgttgaacgtacgtcctagtaactaacgtacgtacggacgacgaccgtagtacctaaccgttacgtaccggggtttacgggaccgggtaacggaacctacgggtccgttaccggtaacccggtaccgtaaccgggtaccaaccggtacccggtaaacgtccggttccccggtcccccgtcggttaacccccg

SEQ ID NO: 150797 - DNA, 546 bp, Homo sapiens
  misc_feature: GYAE6OF01C95ID.7.5.A05.1.454.CMB.1.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagcgtgtctctacacgaccggtgctcgatttagatagatagacgaggggggggtcgtcaggaggcagcgctctcgggacgtctccaccatggcctggctctgctattcctcaccctcctcactcagggcacagggtcgtggcccagtctgccctgactcagcctgcctccgtgtctgggtctcctggacagtcgatcaccatctcctgccactggaacccaccactgacgttgcttggttaataatnctctcctgtatcaacaataccagcaaacgccccaaagtcatcatttangatgtactataatcggccttcagggtttccaatcgcttctctcgtctacagtctaggcacgtacggcctccgcgacctatcctcgtggtcctccgagctagaacgtacgagacgtgtattactactgctagtctctaatactaacgagaccagtcagctacgtcgtacgggtttcggacgggacggacgaagcgtacgaccgtccgtaggtccgacgtacccgtaaggcctaccgccccgtcggtaccc

SEQ ID NO: 150798 - DNA, 613 bp, Homo sapiens
  misc_feature: GYAE6OF01DRNTO.7.5.A05.1.454.CMB.1.raw
  modified_base (303)..(303): a, c, t, g, unknown or other
  misc_feature (303)..(303): n is a, c, g, or t
  modified_base (453)..(453): a, c, t, g, unknown or other
  misc_feature (453)..(453): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttaggttaataaatatctctctggtatcaaacaataccaggacaaacgaccccaaagtcatctatttangatgtctataatcgtcttacgtacgggttccaagtcgtcttctctcggtctaccgaacgttcgtcggaccgacgaccgggtcccttcccgtagaccctactcgtcgtcggctaccgaggtcaggaacgacggagtctagactttatacgngtcagtctagtaataagtacgaagcgtacgacacgtaccaacggttcgttacgggtttaccgggacgggtaaccggaacgtaacggccgtacggtaacccgttccgtacgtacgaacccggtaccgtaacggccctcccggtccccgttggttaaccccg

SEQ ID NO: 150799 - DNA, 536 bp, Homo sapiens
  misc_feature: GYAE6OF01BOWSR.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacataccagacaaacgccccaaagtcatcattatgatgtctatatcgcttcgagggttcatcgcttctctgctcagtctgcgacacgcctcctgacctactctcgtggctccgaggctagaacgacgaggctagtattattaactgacagctacaatactacgaggcagcagccacgttcgtacgggtttcgggacggtacggaaccgacgtcctacggaccgttccgacggtccgaacgacccgaacggccgtcccgtcccccgtcggttaccc

SEQ ID NO: 150800 - DNA, 594 bp, Homo sapiens
  misc_feature: GYAE6OF01DPBTA.7.5.A05.1.454.CMB.1.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactggaaccacactgacgttgctggtaataatntctctctgtatcaacaatacccaggcaaacgccccaaagtcatcatttangatgtctataatcggccttgtacgggtttccaatcgcttctctggctacaagtctggcgacacgcctccctgaccattctcgtcggctccgaggtctagaaacgacgtaggngtacgttagtaatttaacgttacgtcgacgtacgtctactaataactagacggacgtacgacacgctacgtacggtttacgggttaccgggacgggaacggaaccgtaacggtacgtaccggtacccgttacggtaacgaccgtacccggtacccggaaccgtccggtccccgtccccggttacccgg

SEQ ID NO: 150801 - DNA, 617 bp, Homo sapiens
  misc_feature: GYAE6OF01B3OBL.7.5.A05.1.454.CMB.1.raw
  modified_base (264)..(264): a, c, t, g, unknown or other
  misc_feature (264)..(264): n is a, c, g, or t
tcagcgtgtctctacacgaccggtgctcgatttagatagatagacagggggggggttcgtcaggaggcacgcgcctcgtcgggtacgtctcctaccattgggcctgggctctgctaattcctcaccctcctcactcagggctacgagggtcgtgggcccagtcttgccctgactcagcctgcctcgtgtctgggtctctggacctgtcatcaccatctcctgcgacctcggaaccaccactggacggttgcgtaggttataatntcttctcctggtatcaacaatacccaggcaaacgtcccccaaagtcactctatttagtcgtactcgtactataactcggccttcgacggggtttccaatcgccttcgtcttggtcttccgaacgtctcggcgaacaccggtccctccctcgaccactcgtccgtcgggcctccgagtctaggtaacgacgaggacttgtattacttacgtgtctacgtctctaactactacgacggcgacgcgacgcctactcgtcgggtttcggccggtacggaccgaaggtcctaggtacccggttccgtaccgggtccaccgtaccccgtacggaccgtccgtcccccgtcggtaccccg

SEQ ID NO: 150802 - DNA, 612 bp, Homo sapiens
  misc_feature: GYAE6OF01C1FB2.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgaggggtcgtgggcccagtctgccctgactcagcctgcctccgtgtctgggtctccgtggacagtcgatcaccatctcctgcactggaaccacactgacgttgcttaggttaactaaatctctctcctaggtatacaaacaactaccaggacaaacgaccccaaagtcatactattatgatgtctaataactcgtaccttcgtacgggtttaccaattcgtcttctcgtcggctacgaagtctacggcgacgtacggccctccgtcgacctactcttcgcggctccgagcgtagaacgacgacggtactagtatttacgtacgtcgactacgtctataattacgtacgtaacggacacgtacgacgctaacgtcggttacggtttccgggacggacgggtaaccacggtccgtacggtacccgttacgtacggtacgaccgtacccggaacggtcctacccgtccccggtaccgtcccg

SEQ ID NO: 150803 - DNA, 616 bp, Homo sapiens
  misc_feature: GYAE6OF01C20NV.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccacactgacgttgctggttaataatatctctcctggtatacaacaatacccagacaaacgccccaaagtcatcatttangatgtctataatcggtccttcgagggtttcaatcgtcttctctgtctacaagtctgcgacacggcctcccgtcgaccactctcgtggctccgtagctaggaacgacgaggctagtactttattaacctgctaagtcctataagttaactacgacggtaccgagacaagaccttacgtccggttacgggttttaccgggaccgggtacggggtaaccgaaacggtccgtaccgggtaacccggtcccggttaaccggttaccgaaccgggtaccccgaaagggtccccggtacccggtacccccgttccgggttaccccg

SEQ ID NO: 150804 - DNA, 790 bp, Homo sapiens
  misc_feature: GYAE6OF01EB1U8.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctccgtggacagtcgatcaccatcctcctgcactacggaaccaccactgacgttgctagttaataaatatctctcctggtatacaacaactacccagacaaacgaccccaaagtcatctattatgatgtactaataacgtcggtccttacgtacgggtttacctaacgtcgtcctttcgttacgttcgggccttaacaacggttccgttacgggaccgtacccgtaaccggggtccccttacccccgttagaaccccttaattcccgttacggtccgggtacccgtacccggtacgggtacccgtaacgggtaaacgggaaccggtaagggtaccgttaggtttaaactttaaccgtttaacgtacggtaccgtaacggtaccgttaacgtaactaacgttaaccgacggtaccgacggaaccgacggtacctaaccgttaccggttaacggggttttaccgggaccggggtaaccgggtaaacccggtaacggtacccgttaaccggtacccgggttacccgttaacgggtaccccggtaaccggtaccccgggtaaacggtcccccggttacccggtaccccccggtccgggtttaacccccg

SEQ ID NO: 150805 - DNA, 642 bp, Homo sapiens
  misc_feature: GYAE6OF01CMEYZ.7.5.A05.1.454.CMB.1.raw
  modified_base (304)..(304): a, c, t, g, unknown or other
  misc_feature (304)..(304): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaaacaatacccaggcaaacgcccccaaagtcatacatttangatgtactaataatcggtccttcgtacgggtttccaatccgcttctctcggctccaagtctggaccgacgaccggccctccctcgacctatcgtcgtcgggtcctccgacggtcgtagaacggacggaggtctgtaactttattacgtgacacgtctactaacttaagtaacgacggactagaccgaagtacctacgttacggtacgggttttaccggggacggtaacggggtaaccgaacggtccgtacgggtaacccggttcccgtaacgggtacccgtaaccggaccccggtaaacggtcccgttacccggtccccccggttccgggttaccccg

SEQ ID NO: 150806 - DNA, 800 bp, Homo sapiens
  misc_feature: GYAE6OF01DXT5N.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtggcccagtctgccctgactcagcctgcctcgtgtctgggtctcctggacagtcgatcaccatctcctgcactcggaaccaccactgacgttgctaggttataaatntctctcctgtatacaacaactaccaggaccaaacgccccaaagtcatctatttatgtatgtactataactcggtccttacgtacgggtttccaatcgtcttctcgtcggtcctaccgtaagttcgtcggccgtaaccgtacccggtcccttccccgtacgtaccctacttccgtaccgtcggggtaccctaccggacgggtccgttaacggaaacggtaaccggaacgggtacgttaggttaactttaacgtttaaccgtacggtaccgtacggttacctaacgtaacgttaacgtaaccggtaacgggaccgaaccggtaccgtaacgtacccgttaaccgttaccgggtttaacgggggttttacccggggaaccggggtaaaccgggggtaaaccccgtaaacgggttacccgggttaacccgggttaacccccgggtttacccggttaaacccggggttaccccgaaaccccgggttacccccggtaaacggggttaccccccggtttacccccgggttcccccccggttacccgggtttaaccccccg

SEQ ID NO: 150807 - DNA, 593 bp, Homo sapiens
  misc_feature: GYAE6OF01A2A1Z.7.5.A05.1.454.CMB.1.raw
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctaggttaataaatatctctcctggtatcaacaatacccaggacaaagacccccaaagtcatctatttatgatgtactataatcgtccttcgtagggttcaatcgtcttctctgctcaagtcncggcgacacgcctcctcgaccatctcgtggctccaggtctagaacgacgacggtactaggtaatttacgttacgtgtcgagtctanactanacgaggcgtagacgacgctacgttacgtacgggtttccgggacgggtaccgggaaccgtaacggtaccgtacgtacccggtaccgttaacggtcctaacgggaccccgtaaacgggccctaccggtccccccgttcgggtaacccc

SEQ ID NO: 150808 - DNA, 541 bp, Homo sapiens
  misc_feature: GYAE6OF01CSUKL.7.5.A05.1.454.CMB.1.raw
  modified_base (354)..(354): a, c, t, g, unknown or other
  misc_feature (354)..(354): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgcttggttaataaatatctctcctggtatcaacaatacccaggcaaacgccccaaagtcatcatttatgatgtctataatcgccttgagggtttccaatcgcttctctggctacagtcngcgacacgcctcctgacctatctctgggcctccgaggctagaaggacgacggtctgtaattagttactgctagtctactataatacgagacagtcagactacttcgtacgggtttcggacgggacgggaccagtcgtacggaccgtccgtaggcacgacccgaagtccgtcccgccccgtcgtaccg

SEQ ID NO: 150809 - DNA, 579 bp, Homo sapiens
  misc_feature: GYAE6OF01DOYGK.7.5.A05.1.454.CMB.1.raw
  modified_base (369)..(369): a, c, t, g, unknown or other
  misc_feature (369)..(369): n is a, c, g, or t
  modified_base (444)..(444): a, c, t, g, unknown or other
  misc_feature (444)..(444): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctgtatacaacaactaccaggacaaacgccccaaagtcatactatttatgatgtctaataatcgtcttcgtacgggtttacaatcgtcttctctcgctcaagtcgtggcgacncggccctccctgaccactcgtcgtcggctccgacggctagaacgacgaggtctagtattattactgacagtctanatatacgaggcacgcgacgctacgtcgtacgggtttccgggacgggacgggaaccgaacggtccgtacggtacccggttccgtacggtaccgaccggtacccgaacggtcccgtcccggcccccgtcggtacccg

SEQ ID NO: 150810 - DNA, 580 bp, Homo sapiens
  misc_feature: GYAE6OF01EJQ21.7.5.A05.1.454.CMB.1.raw
  modified_base (327)..(327): a, c, t, g, unknown or other
  misc_feature (327)..(327): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaaccaccactgacgttgctggttataaatatctctcctggtatcaaacaatacccaggacaaacgacccccaaagtcatcatttatgatgtctaataatcggtccttnacgggtttacaatcgtcttctctgtctctaagtctcggcgacacgtcctcccgttcgacctaatctcgtcggccttaccgagtctaggtaagaccgaggtctagtatttatacgttgacacgctctatatacgacgcagctaagccacttacgtacgggtttcggaccgggtacggaaccgaagccgtacgacccggttacccgtacggtacacgacccggtacggtaccgtcccgccccgtccggttacccg

SEQ ID NO: 150811 - DNA, 538 bp, Homo sapiens
  misc_feature: GYAE6OF01CHMB8.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatatctctcctggtatcaacaatacccaggcaaacgccccaaagtcatcatttatgatgtctataatcggcttcagggtttccaatcgcttctctggctcaagtctggcgacacggcctccctgaccatctctcggctccgaggctagaacgacgaggctggtatttatactgcagctcatatacaggcagcagcactcgtacggttttcggacgggtacgggaccgaacgtcgtacggacccgtcgtacggtcacggacccgaacggcccgtcccggcccccgttcggtacccg

SEQ ID NO: 150812 - DNA, 533 bp, Homo sapiens
  misc_feature: GYAE6OF01BISAH.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttcaatcgcttctctggctccaagtctggcgacacggcctccctgaccatctctggctccaggctgaagacgaggctgatttattactgctagctacatactacaggcagcagcactcgtaggttttccgggcggacgggaccgaacgcgtagacccggttccgtacggtccacggtacccgacggcctccggtcccccgtcggtacccg

SEQ ID NO: 150813 - DNA, 553 bp, Homo sapiens
  misc_feature: GYAE6OF01BOYWX.7.5.A05.1.454.CMB.1.raw
  modified_base (250)..(250): a, c, t, g, unknown or other
  misc_feature (250)..(250): n is a, c, g, or t
  modified_base (534)..(534): a, c, t, g, unknown or other
  misc_feature (534)..(534): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcaccatctcctgcactggaaccaccactgacgttgcttaggttaataaatntctctcctggtactcaacaataccagacaaacgccccaaagtcaatcatttatgatgtctataatcgcttcgagggtttcaatcgcttctctcgctctaagtctcggcgacaccgtcctccctgacctatcctcgtcggctccgaggctagaacgacgtaggtctagtattattactgtacagtctacatactacgaggcagtcacgtcacgtcgtacggtttcgggacggaggaacccagccgttggacccgttacgtcgtaccgacgtaccgacggtacccnccgtcccccgtggtacccg

SEQ ID NO: 150814 - DNA, 548 bp, Homo sapiens
  misc_feature: GYAE6OF01CLEZC.7.5.A05.1.454.CMB.1.raw
  modified_base (296)..(297): a, c, t, g, unknown or other
  misc_feature (296)..(297): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatatctctcctggatcaacaatacccagcaaacgccccaagtccatcatttannatgtctataatcggccttcgtagggttccaatcgcttctctgctcagtctgcgacacgcctccctgccatctctcggctccacggctgaacgacgaggcgtagtacttattactgctacgctcaattacacgacggctagcacgcacggttacgtgggttttccgggcggtacgggaccaaggtccgtacggtacccgtccgtaggtaccacgggaccctaacggccttcccggcccccgtcggttccccg

SEQ ID NO: 150815 - DNA, 598 bp, Homo sapiens
  misc_feature: GYAE6OF01B3RQ5.7.5.A05.1.454.CMB.1.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactggaaccaccactgacgttgctggttataatntctctctggtatcaacaactaccaggacaaacgccccaaagtcatcatttangtatgtntataactcggccttgtacgggtttcaatcgtcttctcgtgcctactaagtcgtggaccgacgtaccggtccctccctacgacctactcctcgtcggcctccgaggtctaggaacgacgaggtctaggtatttacgttactgccagccttacattaacacgaggacagacacgacctacgttcgttagggtttaccgggacggggacgggtaaccaacggtctacggtacccgttcggtacgtccgaacggtaccccgaggtccccgttacccgcccccggttagtaccccg

SEQ ID NO: 150816 - DNA, 598 bp, Homo sapiens
  misc_feature: GYAE6OF01CI7VS.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgctccgtgtctgggtctcctggacagtcgatcaccatctcctgcactggaacccaccactgacgttgcttggttaataaatatctctcctggtatcaacaatacccaggcaaacgccccaaagtcatcatttatgatgtctataatcgccttctagggtttccaatcgcttctctgctcaagtctggcgacaccggccctcctcgacctactctcgtcggtctccgagctaggaagacgacggtctagtaattacgttacgtcgcgtacgtctactaactacgtaaccgacggacacgaccgacgtacctacgttcgttacgggttttccgggacgggtaacggggacctaacggtcgtaccggtacccgttccggtacggtaccgaccgtacccggaacggtcccgtcccggtcccccgttcggtaccccg

SEQ ID NO: 150817 - DNA, 541 bp, Homo sapiens
  misc_feature: GYAE6OF01BKWA2.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacagggggggggtctcaggaggcagcgctctcgggacgtctccgaccagtggcctgggctctgctattcctcaccctctcactcagggcacagggtcgtgggcccagtctgccctgactcagcctgcctccgtgtctgggtctcctggacagtcgatcaccatctcctgcactggaaccacctactgacgttgctaggttaataaatntctctctggtatcaacaataccaggacaaacgccccaaagtcatctatttatgatgtctataatcggtccttcgtacgggtttccaagtcgtcttctctggcctacaagtctggcgacaccggtccctcccgtcgacctactctcgtcggcctcgacgggctaggaacgacgacggctagtattattacgtgcagctacatatacgaggcagcagctactcgtacggttcggcggtacggaccgagcgtagaccgtcgtacggtcacgccgaggcctcgccccgtggtcc

SEQ ID NO: 150818 - DNA, 554 bp, Homo sapiens
  misc_feature: GYAE6OF01BZVCJ.7.5.A05.1.454.CMB.1.raw
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctgtatcaacaatacccaggacaaacgcccccaaagtcatcatttangatgtntataatcgccttcgagggtttccaatcgcttctctgctcagtcngcacacggcctcctgacctatcctcgtcggccttccgngtctagaagacgtaggctagatttattacgtgccagtctatataagcgaggcagacagtcctacgtcgttacgggttcggacgggacggaactacggtcgtaccgacccgttcgtacgtaccgaccgacccgtaacgtcccgtccccgtccccgtaccgtacccg

SEQ ID NO: 150819 - DNA, 781 bp, Homo sapiens
  misc_feature: GYAE6OF01DWK63.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcgagggcacgagggtcgtgggcccagtctgccctgactcagcctgcctcgtgtcgtgggtctccgtggacagtcgatcaccatcctcctgcacgtacggaacccacactgacgttgcttaggttaataaatctctcctcctagtactacaacaactacccgaggacaaaccgaccccaaaagtcactactatttactagtattgtacttaataacgtccggtacctttacggtaacgggtttaccaagttccgtctttccgtacgtcggtacctaccgtaacgttcgtacggaccgaccgtacccggtccctacccgtcgtaacccttacgtccgttccggtccgggtcccttacccggaacgggtaccgttacgggaaaacggtaccgggtacggtaccgtttaagtaacgtttaactttaccgtacggtacctaacggtactaacttaacgtaacgtaaccgtacgggaccacgtaccgtaacgtaccttaaccggtttacgggttacgggttttacccgggaccggggtaaaccgggtaaaccctacgggtacccgttaccgggtaccccggttaacggtaaccgggtacccgaaccgggtaccccgtaacgggtacccgttacccccggtcccccggttacggttacccccg

SEQ ID NO: 150820 - DNA, 559 bp, Homo sapiens
  misc_feature: GYAE6OF01EMRX7.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttcaatcgcttctctgctcaagtctggcgacacggccctccctgaccatctcgtcggctccagctgagacgaggctagtatttattactgcagctcatactacgagcagcagcacgtcgtacgggttttcgggacgggtacgggaaccgtaacggtcgtacggtacccggttcccgtacgggtaccgaccggacccgtaacgggtccgttacccggttcccccgttcgggtaccccg

SEQ ID NO: 150821 - DNA, 629 bp, Homo sapiens
  misc_feature: GYAE6OF01C2TS2.7.5.A05.1.454.CMB.1.raw
  modified_base (315)..(315): a, c, t, g, unknown or other
  misc_feature (315)..(315): n is a, c, g, or t
  modified_base (476)..(476): a, c, t, g, unknown or other
  misc_feature (476)..(476): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctccgtggacagtcgatcaccatctcctgcactggaaccacactgacgttgcttaggttaataaatctctctccgtagtactacaaactaactacccgaggacaaacgacccccaagtcattcatttatnatgtactaataagtccggtcctttacggtacgggtttaccaagtccgtcttccgtacgttcggtcctaccgacgttccgtacggaccaccgtccggtccctcccgtacgacctcgtccgtcgtcggcctcgacgcgtagaacgcgagtcagtattagtacngcacgtctactatactcgaaggtcaagtcgacgtactacgttacggttcgggttaccgggacggtaacgggaaccgtaacgtccggtaggtaccccgtcgtacggttaccgaaccgtacccgaacggtccctccccggtcccgttcgtacccg

SEQ ID NO: 150822 - DNA, 651 bp, Homo sapiens
  misc_feature: GYAE6OF01B7IDG.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatcctcctgcactggaacccaccactgacgttgcttggttaataatatctctctgtactcaacaactaccaggacaaacgaccccaaagtcatctatttatgatgtactaataacgtccggtacctttacgtacgggttttaccaagttccgtctttccgtcgtcggaccttaccgaagttccgtggaccgaccgtacccggtcccttacccgtcgaccctactccttcgtcgggtcctaccgacgcgtagaacggacggacggcttagtaatttattacgtcgacacgtctacgtaatacgtaacgaggacacgtacacgtactacgttacggttacgggtttccgggacgggacgggtaaccgaacggtccgtaccggacccggttccggtaacggtacccgacggacccgtaacggcccgtccccgtcccccgtcggttaccccg

SEQ ID NO: 150823 - DNA, 563 bp, Homo sapiens
  misc_feature: GYAE6OF01BGAXE.7.5.A05.1.454.CMB.1.raw
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggccttctaggggtttccaatctcttctctgctcaagtnggcgacncggccctcctgaccatctcgtggctccgagctagaagacgaggctagtatttattacncgnagtctanatagtaacgtaggcacgtcaacgctacgtacgttagggttttccgggacgggacgggaaccgaaggccgttacggacccggttaccgtacggtccaacggacccgtaacggcctcccggtcccccgttcgggttacccc

SEQ ID NO: 150824 - DNA, 539 bp, Homo sapiens
  misc_feature: GYAE6OF01DGNNE.7.5.A05.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttataaatntctctctgtatcaacaataccaggcaaacgccccaaagtcatctatttangtatgtactataatcggcctttcgagggttccaatcgtcttctctgctcagtcngcacacgcctccngaccatctcgtcggctccgagtcagaagacgaggctagtattatacgtgcagtctacatatacaggcagcagcactcgtacggtttccggacgggacggaccgaggtccgtacgtaccgttccgtacggtacgaccgtacccgaacggtcccgtcccgcccccgtcggtacccg

SEQ ID NO: 150825 - DNA, 674 bp, Homo sapiens
  misc_feature: GYAE6OF01CEI6H.7.5.A05.1.454.CMB.1.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtggcccagtctgccctgactcagcctgcctcgtgtctgggtctctggacagtcgatcaccatctcctgcactgaacccacactgacgttgcttaggttaataatatctctcctaggtatacaacaactaccaggacaaacgccccaaagtcatctattangatgtctataagtcgtcttcgtagggttacatcgtcttctctcggctacgagtcgtgcgacncgtcctccacgacctatctcgtcggcctcgacgacgtagaacgaggacgtgtagtaattacgttacgtcgtacagtacctactaataacgtaacgaacggacaacggtccgaacgtcgtaaaccgttccgggtttaacggggtttacccgggaccgggggtaaccgggtaaacccggtaaacgggtacccgttacccgggttaaacccggttacccccggtaacgggttaccccggtaaccgggtaacccccgggtaaacggtacccccgggttccccggggtaaccccccccgttccggggttaaccccc

SEQ ID NO: 150826 - DNA, 609 bp, Homo sapiens
  misc_feature: GYAE6OF01EVCHT.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaacccaccagtgacgttgctaggttaataaatctctctcctggtatacaacaactacccaggacaaacgaccccaaagtcactactaactttagtagtatgttactaataacgtcggtccttcgtaacgggtttccaatcgtcttctcgtcgctaccgtaacgtcgtcggccgaccgaccggtccctccctacgacctactccgtcgtcggcctccgacggtctacggaacgacgagtctagtactttaacttactcgacgtgctacaatactacgagcagtcactctacgtcgttacgggttccggacgggtaccgaaccgtagccgtacggacccgttcggtacgacgacggtacccgacggtccctccggtccccgtcgtacccg

SEQ ID NO: 150827 - DNA, 517 bp, Homo sapiens
  misc_feature: GYAE6OF01DJMVH.7.5.A05.1.454.CMB.1.raw
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccacactgacgtttgctggttataaatatctctcctggtatcaacaatacccaggcaaanccccaaagtcatcatttatgatgtctataatcgcctttcagggtttccaatcgcttctctggctcaagtctggcgacacggcctccctgaccatctctcggctccaggctggaagacgagcgtgattattactgcagctcatatacagacagcagcactcgtaggttttccggnggacgggacaacgctacggccgtccgtagtccgacgaccgtaagcctccggccccttcgggtaccc

SEQ ID NO: 150828 - DNA, 743 bp, Homo sapiens
  misc_feature: GYAE6OF01DABOH.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttaataatatctcctctggtactacaacaatcgacccaggaccaaaacgccccctaagaactactacttacttatttagtagattcgttactaacttaaccgtccgttaccgttcggttaaccgggttaacctacgtccttaccttcgttcgtcgtacctacgtacgtcgtaccggaccgaccggtaccgtccccgttcgtacccgtacctacgttccgttcggtcccggtccgtaccgtacgggtacgtaacggtaacgggaacggtcggtacgttaagtttaactttaacgttacgtacgtacgtacccgttctaaacttagtaaccgtaacggtacggacacggacgtaccgtacgttaccgttacgggtttaccgggtaccggggtacgggaaacccgggtaaccgaggttacccggtaaccgtaaccccgggttaccggtaccggtaaccgacccggtaccccggtaacccggtccgttaccccccgggttacccccgg

SEQ ID NO: 150829 - DNA, 549 bp, Homo sapiens
  misc_feature: GYAE6OF01EURW1.7.5.A05.1.454.CMB.1.raw
  modified_base (246)..(246): a, c, t, g, unknown or other
  misc_feature (246)..(246): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaataccaggacaaacgcccccaaagtcatcatttatgatgtctatatcgcttcgagggtttccatcgcttctctggctcaagtcgtggcgacacggccctccctcgaccatcctctgggcctccgaggctagaacgacgaggcgtgaatttattactgcacgctacaatataacgaggcagcagcacgtcgtaggtttcggacgggagggaccaacggctacggacccgttcccgtaagggtccaacggacccgaacggtcccgtcccgcccccgttcggtaccccg

SEQ ID NO: 150830 - DNA, 659 bp, Homo sapiens
  misc_feature: GYAE6OF01BB1YG.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaacccaccactgacgttgctggttataaatatctctcctgtatcaacaataccagacaaacgcccccaaagtcatctatttatgatgtactataagtcgtccttcgtacgggtttccaatcgtcttctcgtcggtctaccgaagtcgtggccgtacgaccggtccctccctcgaccctacttccgtcgtcgggcctccgtacggtctaggaacgacggaggtcgtagtatttacttacgtcgactacgcttacaattaacgtacgaggcaacgacctacggacctacgttaccggttacggggtttaccgggacggggttaaccggggaaacctacgggtaccgttaccggtaccccggttaccggttaacggtacccgaacggtaacccccggaacgggtccccgttacccccgggtcccccggttccgggtaaccccg

SEQ ID NO: 150831 - DNA, 537 bp, Homo sapiens
  misc_feature: GYAE6OF01CGBW4.7.5.A05.1.454.CMB.1.raw
  modified_base (351)..(351): a, c, t, g, unknown or other
  misc_feature (351)..(351): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccaggcaaacgcccccaaagtcatcatttatgatgtctataatcggccttcgagggtttccaatcgcttctctgctcagtcngcgcacgcctcctgaccatctcgtcggctaccgaggctacgaagacggaggcgtagtatttattactcgacacgctacatactacgacggcagcgagcactcgtacgggtttcgggacggacgggaaccacggcctaggaccggtcctaggtcaccggccaacggcctcccgccccgtcggtaccc

SEQ ID NO: 150832 - DNA, 566 bp, Homo sapiens
  misc_feature: GYAE6OF01CB3I5.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccagacaaacgcccccaaagtcatctatttatgatgtctataatcggccttcgagggtttccaatcgtcttctctgctcaagtctggcgacacggccctcccgtgaccatctcgtcgggcctccgaggtctaggaacggacggaggtcttagtatttaacttacgtgacagtctcaattactacaggacagcagactacgtcgtagggtttcggacgggacgggaccaagtccgtaggacccggttccgtacggtacaccggtacccgaacggcctccggtcccccgtcggtacccg

SEQ ID NO: 150833 - DNA, 761 bp, Homo sapiens
  misc_feature: GYAE6OF01DKDRL.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctccgtggacaggtcgatcaccatctcctgcactggaaccacacgtgacgttgctggtaataatatctctcctgtatacaaacaactaccgaggacaaacgcccccaaagtcatctatttatgatgtctaataactcggtacttcgtacgggtttaccaagtcgtcttctcgtcggctacaagttcgtggccgaaccgcggtccctcccgtacgacctattcctcggtcggctaccggtacggacgtaacggaaacggaacggtaggtaccgtaaggttaactttaacgttttaacgtcgggtacctaagggtccttaactaacgtttaaacgtaaccggtaagggaccgtaaccggaccgtaacgtacccgtttaacccggtttacgggttaaaccgggggttttttcccggggaaccgggggaaaaccgggtaaacccggtaaacggtacccggttacccgggttaaacccccgggtttaaccggaaccggggtttaccccgaaaccgggtaacccccggttaaacgggtacccccgttccccgggttaccccccggttacggggtttaaccccc

SEQ ID NO: 150834 - DNA, 565 bp, Homo sapiens
  misc_feature: GYAE6OF01EC721.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctctgtatcaacaataccagcaaacgccccaaagtcatcatttatgatgtactataatcggtccttcgtagggtttccaagtcgtcttctctggtctccaagtcgtggcgacaccgccctcctacgacctactctcgtcgggtcctccgaggtctaggaacgacggaggctgtaatttacttacgtgcacgtctacatactacgaggacagacagacacgttcgtacgggtttcggacgggtacgggaccgaacgtcgtacgaccggtccgtacggtcacggtcccgaacggcctcccggtcccccgtggtcccg

SEQ ID NO: 150835 - DNA, 722 bp, Homo sapiens
  misc_feature: GYAE6OF01BSR2X.7.5.A05.1.454.CMB.1.raw
  modified_base (221)..(221): a, c, t, g, unknown or other
  misc_feature (221)..(221): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccnccactgacgttgctggttaataaatatctctctgtatacaacataccaggacaaacgaccccaaagtcatctatttatgatgtctataagtcgtccttagtacgggtttccaagtcgtccttctcgtcggtctaccgtaacgtcgtacggccgtaaccgaccgggtccctacccgtacgaccctacttccgttaccgttcgggtccgtacccggaacgggtaccgttagggaaaccggtaaccggacggtacgtttacgtaagttttaactttaacgtcgtaccgtaaggtccttacgtaaacttaacgtaaccggtaaggaccgtaacgaccgtacgtacccgttaaccgttaccgggttaacggggttttacccggggacggggtaaaccggggtaaacccgtacggtacccgttaccgggtaaccccgtccgggttaacggtaccgaccggtaaccccgacgggtacccgttccccggtcccccggttcggtaccccg

SEQ ID NO: 150836 - DNA, 564 bp, Homo sapiens
  misc_feature: GYAE6OF01ERU78.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctgtatcaacaatacccaggcaaacgcccccaaagtcatcatttatgatgtctataatcggccttcgagggtttccaatcgtcttctctgctcaagtctggcgacacgcctccctcgaccatctctggcctccgaggctagaacgacgaggctgtattattactgcagctatactatacgaggcagcgagctacgtcgtagggttttaccgggacgggaacgggacctaacggccgtacggtaacccggttccggtaacggtccgaaccggtacccgaacggcccgtcccggtcccccgtcggttaccccg

SEQ ID NO: 150837 - DNA, 796 bp, Homo sapiens
  misc_feature: GYAE6OF01CMELM.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctccgtggacagtcgatcacatctctgcactggaaccacgactgacgttgcttaggttataatatctctctggtatacaacaatacccgaggacaaacgaccccaaagtcactactatttatgatgttactaataacgtcggtacctttcgtaacggggtttcccaaagttcccgtactttcctcgtcggtacctaccgtaacggttcgtacggaccggtaaccgtacccggtccccttacccgtacgacctacgttccttccggttacggtccgttaccggacggtacgtaacgggtaaacggacggtaacgggtacgtttaggttaactttaacgtttaccgtacggtacctcgtaccttaataacgtaacgtttaacggaacggtaccgaacgtccgtaacggtaccgtaacccggttacggttaaccgggttttcccggggggaaccgggtaaccggggtaaacccgtaaccgggtacccggttacccgggtaaccccggtttaccccggttaacggggtaccccggtaaacccgtaacccccggggtaacccgggttaccccggtaccccccgggttcccccgtttaccggggggtttaaacccccc

SEQ ID NO: 150838 - DNA, 638 bp, Homo sapiens
  misc_feature: GYAE6OF01D2WEY.7.5.A05.1.454.CMB.1.raw
  modified_base (171)..(171): a, c, t, g, unknown or other
  misc_feature (171)..(171): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagcgtgtctctacacgaccggtgctcgatttagatagatagacgaggggggggtctcaggaggcagcgctcgtcgggacgtcctccaccatggcctgggctctgctattcctccaccctcctcactcgagggcacgagggtcgtcgggcccagtctcgccctgacctcncgcctgcccttcgtgtcgttcggtcctccgtaggactacggtcatccacctatcctcctcgactaccgtacggaacccacctacgtcggtaccgttgacgttagttaataactcttctctccgtagtaactacaaactacgtaccgacgaaccaaccgacccctaagtctacttntattatgtactgtactaatacgtccggttctcggtacggttctagtctntctcgngtactacgacgtcgcgacgcaccggtcctacgtagcctacttcgcgttcggctacgcgtnacggagtcgagtntatattctcngctanacgtatagtacgtgacgtacagaccgtaattcgtacgtttcggacgggttaccggagggaaccgtacgtacggtcccggttaacgtaccggtaccgaggtaccctacgggcccggttaacggccccttccggggcccttaggtaccccg

SEQ ID NO: 150839 - DNA, 557 bp, Homo sapiens
  misc_feature: GYAE6OF01B8AS4.7.5.A05.1.454.CMB.1.raw
  modified_base (252)..(252): a, c, t, g, unknown or other
  misc_feature (252)..(252): n is a, c, g, or t
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
tcagcgtgtctctacacgaccggtgctcgatttagatagatagacagggggggggtctcagggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgaccgttgcttggttaataaatntctctcctggtatacaacaataccaggacaaacgccccaaagtcatctatttatgattgtactataactcggaccttcgacgggtttcatcgtcttctctggctccgaatcgtgcgacncgcctcctgaccatctcgtggctcgngntagaagcgngntgattatactgtacngctactatacgacacggactagaccgtacgtctaacgttcggtacgggtttccggacgggtaacggacctaaggccgtacgacccggtcgttacggcctacggaccgacgtacccgccgtcccgtcgtcccg

SEQ ID NO: 150840 - DNA, 615 bp, Homo sapiens
  misc_feature: GYAE6OF01BJ2EZ.7.5.A05.1.454.CMB.1.raw
  modified_base (246)..(246): a, c, t, g, unknown or other
  misc_feature (246)..(246): n is a, c, g, or t
  modified_base (492)..(492): a, c, t, g, unknown or other
  misc_feature (492)..(492): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcactggaaccaccactgacgttgcttgttaataaatntctctctgtatcaacaataccaggacaaacgccccaaagtcatctatttatgatgtctaataagtccgtcttcgtagggtttccaattcgtcttctctggctacaacgtcgtcggcgacgaccggtccctccctacgaaccatccgttcgtcggtcctaccgaggtcgtaggaaacgacggaacggtccttaggtaactttaacgttaacgtcgctagtacgtactaattactacgaaggcaacgnacgacctacgtacgttacggtttcgggacgggtacggaaccgacggtctacccggtaccggtacccgttaggacccgaccggtacccgaacgggtccctcccggtcccccgttcggtaacccg

SEQ ID NO: 150841 - DNA, 697 bp, Homo sapiens
  misc_feature: GYAE6OF01C8IS8.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtcgggcccagtctgccctgactcagcctgcctccgtgtcgtgggtcctcgtggacaggtcgactccaccatcctcctgacgtacgtcggaacccacctacgtgacgttgcttaggttaataatactctcctctgtactacaacacgtacccaggacaaccgccccaagtacatactattatgtactgtactatacgtcggttctcgtaggtttaccagtcgtcttctcgtcggtctactacggtctggaccgaccgtaccggtcccctccgtaccgtacctcttcccgtcggtccggccttccggacggtcgtacggtaacggacggtacggtacttaacggtatttacgtactcgatacgtcgtaacgtactaagaaccgtacggacgacgtaccgacgtacgttaccggttcggttaaccgggtttacgggaccggggtaccgggtaacgaacgggtccgttaacccggtacccggttacggtaaccgggtacccgaacccggtacccggttaaccggcccggtaaccccggttcccccggtaggttacccccg

SEQ ID NO: 150842 - DNA, 527 bp, Homo sapiens
  misc_feature: GYAE6OF01CXWP1.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatntctctcctggtatcaaacaatacccaggacaaacgcccccaaagtcatcatttatgatgtactataatcggtccttcgacgggtttcaatcgtcttctctgctcaagtctgcgacacgcctcctcgaccactctcgtggctcgagctagaacgacgaggtctagattattactgacagtctcatactacgaggcagacagcactcgtacggtttcggcggtacggaccagcgtacgaccgtcgtacgtcgacgtccgaaggcctaccgccccgtcggtaccc

SEQ ID NO: 150843 - DNA, 646 bp, Homo sapiens
  misc_feature: GYAE6OF01AX3DC.7.5.A05.1.454.CMB.1.raw
tcagcgtgtctctacacgaccggtgctcgatttagatagatagacagggggggtcgtcgaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggacaaacgcccctaaagtcatactatttatgatgtctatactcgccttcgacgggtttccaatcgtcttctcgtggtctaccgtaacgtcgtcggtccgacaccgggccctcccgtacgaccctatctcgtcggcctccacggtctcggaacgacggacgtctagtaacttagttaactcgtacacgtcgtacaacttacgtacgacggtacacgaccagtaccaaccgttccgttacgggttttaccgggaccggtaacgggtaaccgtaaccggtacgttaccgggtaaccccgttaccggttaaccgggtaccgaccgggtaccccgtaaaccgggtccgtaccccgggttccccccgttccgggtaaccccg

SEQ ID NO: 150844 - DNA, 700 bp, Homo sapiens
  misc_feature: GYAE6OF01DIEML.7.5.A05.1.454.CMB.1.raw
  modified_base (310)..(310): a, c, t, g, unknown or other
  misc_feature (310)..(310): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaacccaccactgacgttgcttaggttaataatatctctcctggtatcaaacaactacccaggacaaacgccccaaagtccatctatttangtatgtctataatcggtcctttcgacggggtttccaatccgtcttctctcggctaccgaagtcgtggaccgacgtacccggcccttcccgtcgaaccctacgtccgttcggtcgggtaccctcccggaacgggtacttacgggaaacggtaccgggaggtacgttacggttaatttaactttaaccgttacgctaacggtccttaacgtaacttaacgttaaccgacgggacctacgaccgacgtacctaacgtttccggttaacggggttttaccgggacggggtaaaccgggaccgtaacggtaccggtaccggtacccggttaccgtacgggtaccgaaccggtacccgaacggtccctaccccggtccccggttcggttacccccg

SEQ ID NO: 150845 - DNA, 535 bp, Homo sapiens
  misc_feature: GYAE6OF01CYA1B.7.5.A05.1.454.CMB.1.raw
  modified_base (296)..(296): a, c, t, g, unknown or other
  misc_feature (296)..(296): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccagacaaacgccccaaagtcatcatttangatgtctataatcgccttcgagggtttccaatcgcttctctggctcaagtctgcgacaccggcctcctgaccatctcgtcggctccgagctagaagacgaggctgattattactgcatctctaatagtacaggctagacagctactcgtacgggttttcggcggacgggaccgaagcgtacgtacccgtacgtacggtaccgacggtacccaacggcgtcccgcccccgtcggtacccg

SEQ ID NO: 150846 - DNA, 713 bp, Homo sapiens
  misc_feature: GYAE6OF01A76RW.7.5.A05.1.454.CMB.1.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagcgtgtctctacacgaccggtgctcgatttagatagatagacaggggggggtctcaggaggcagcgctcgtcgggactctccgacctatggtcctgggcctctgctattcctcaccctcctacactcagggcacaggggtcgtgggcccagtctgaccctgactcagcctggcctccgtgtctggggtctccgtaggacaggtcgatcgaccgagtccgtccgtggctaacgtcgggaaaccaccgacttggtaccgttgaccttaggtttaanaaattntcctcttacctaggttaatactaaacaactaccgaggcgaaacgcccccaaagtccatacgtactttagtaggacttgtacgtataagtcggtcttcgtaagggtttccaatcgtctcgtctggtactcgaagtcgtacggacgtaccgtaccggtccctcccgtacggaacctacttccgtacgtcgggtaccttacccgagggtaccgtaacgtaaacgacccggtagggtacctaggtaacctttaacggttactacgactaacggtctaacctaagttaacgtaccggaggaccgtacggacaacgtcaaccgttcgttaacgggttccggacgggtacgggaaccacggtcgttaaccggtacccgtaacggtacggtcggaccgtaccggtaagggtccgttcccggtcccggttaggtacccg

SEQ ID NO: 150847 - DNA, 558 bp, Homo sapiens
  misc_feature: GYAE6OF01DBXL5.7.5.A05.1.454.CMB.1.raw
  modified_base (327)..(327): a, c, t, g, unknown or other
  misc_feature (327)..(327): n is a, c, g, or t
  modified_base (455)..(455): a, c, t, g, unknown or other
  misc_feature (455)..(455): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccatgacgttgctaggttaataaatatctctcctggtatacaacaatacccaggacaaacgccccaaaagtcatctatttaatgtaattgtactataatcgccttnacgggttccaagtctcttctctgctcagtctgcgacacgcctcctcgacactcgtcgtggcctccgagctagaacgacgagctagtattacttagtcgacgacgtcgtactagtactaacgaggtacncggacacgactacgttgttacgggtttcggacggacggaccgaacgtcgtcgtaccgtccgtacgtcgaacgcccgaacgcctcccggccccgtcggtacccg

SEQ ID NO: 150848 - DNA, 536 bp, Homo sapiens
  misc_feature: GYAE6OF01A6WGL.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctgtatcaacataccagcaagccccaagtcatcattatgatgtctatatcgtcttgtagggttcaatcgtcttctctgctcagtctgcgacacgcctcctcaccatctctggctccgacggctggaacgacgaggtctagtattattactgacagtctacagtacgtacaggacagtacacgtactacgtcgtacgggtttcgggacggtacggaaccgacgcgtacgtacccggtccgtaggtccgacggtcccgaaggtccctccggccccgtcggtaccccg

SEQ ID NO: 150849 - DNA, 563 bp, Homo sapiens
  misc_feature: GYAE6OF01CA4BC.7.5.A05.1.454.CMB.1.raw
  modified_base (167)..(167): a, c, t, g, unknown or other
  misc_feature (167)..(167): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctnccggtcctgtctgggtctcctggacagtcgatcaccatctctgcactggaaccaccactgacgttgctggttataatatctctcctggtatcaacaataccagacaaacgccccaaagtcatcatttatgatgtctataactcgcttcgagggtttacaactcgcttctctgctacagtctggcgacgacggcctccgtcgacctatccttcgtcgggcctacgaggctagaacgacgaggctagtattattacgtgactagtctacaatactacgaggacaggacagctacgtacggttacgggtttcgggacgggaacgggtaaccaacggtcgtacggaccgttcggtacgtccgaacggtaccccgaggtccctccgcccccgtcggtaccc

SEQ ID NO: 150850 - DNA, 543 bp, Homo sapiens
  misc_feature: GYAE6OF01B8AQL.7.5.A05.1.454.CMB.1.raw
  modified_base (222)..(222): a, c, t, g, unknown or other
  misc_feature (222)..(222): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccnccactgacgttgcttggttaataaatatctctctggtatcaacaactacccaggacaaacgccccaaagtcatcatttatgatgtctataatcgcttcgagggtttcatcgcttctctgctcaagtctgcgacacggcctcccgtgaccatctctcggctccgagctgaagacgagctgtattatactgactagctactatactacgaggcagcagtcacgttcgtaggtttccggacgggacggaaccgtagtcgtacggacccggttcgtacgtaccgacggtacccgaacggtcctcccgtccccgtcggttaccccg

SEQ ID NO: 150851 - DNA, 647 bp, Homo sapiens
  misc_feature: GYAE6OF01DXAKU.7.5.A05.1.454.CMB.1.raw
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacgaggggtcgtgggcccagtctcgccctgactcagcctgcctccgtgtcgtgggtctccgtggacagtcgatccacctatcctcctgccacgtacggaacccacctactcggaccgttgtcgttaggttaataaatctctctccgtgtatacaaacaactaccgaggacaaaccgaccccaaagtcatactatttangattgtactaatacgtcggtctttcgtacgggttttccaatccgtnttctcgtacgtctaccgagtcgtcggaccgtaaccgccggtccctcccgtacgaccctacttccgtacgtccgggcctccggacggtcgtaaggtaacgacggtcggtacttagtaactttacgttactcggactacgtactacttataacgtacgacggtcaacgtcacgtctacgtggttacgggttcggacggacggactaggtccgtaccggtacgtccgagtaccgaccggtacgacggtcccgtaccccggtccgtcggttccc

SEQ ID NO: 150852 - DNA, 673 bp, Homo sapiens
  misc_feature: GYAE6OF01AVQYJ.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaaacaatacccaggacaaacgcccccaaagtcatcatttatgatgtctaataatcgccttcgagggtttccaatcgcttctctcggctaccaagtctcggacgaccgaccggtccctccctagaccctataccgtcgtcggggcctacccgacgggtctacgggtaaacgaccgggtaagggtcgttacgtaatttaacgtttactcgacgtacgtaccttacgaaacttagtaaccgaggaccaggacacgtaccacgtaccggttacgggttttaccgggacgggaaccggggtaacccgaacgggtccgtaccgggtacccggttacccggttaccgggtaacccgtaaccgggtacccctaaaccgggtacccgtccccggtaccccccggttccgggttacccccg

SEQ ID NO: 150853 - DNA, 678 bp, Homo sapiens
  misc_feature: GYAE6OF01CJKUX.7.5.A05.1.454.CMB.1.raw
  modified_base (311)..(311): a, c, t, g, unknown or other
  misc_feature (311)..(311): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacaggggtcgtgggcccagtctgccctgtactcagcctgtcctccgtgtctgggtctccgtggacagtcgatcaccatctcctgcactggaacccaccgactgacgttgcttaggttaataatatctctcctggtatcaactaactacccaggaccaaacgccccaaagtcatcatttangatgtactaatagtcggccttcgacgggtttaccaatcgtcttcgtcgtcggtcctacgaagttcgtcggtaccgaccgtaccggtccccttcccgtacgtacccgtacttccgttccgtaccgggtccttacccgaggtaccgtaggaaacggacggtacggtacttaaggtatttacgttactcgtactaagtctacaacttacgtcgaacggtacacgacacgtacgtacgttcggttaacgggttcgggacgggtacgggtaaaccgtacggtaccgtacgggtaacccggttcggttacggttaccgaacccggtaccccggtaacggtccccggttaccccggtcccccggttggtacccg

SEQ ID NO: 150854 - DNA, 646 bp, Homo sapiens
  misc_feature: GYAE6OF01ARPW0.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctctgtatcaacaataccagacaaacgccccaaagtcatctatttatgatgtctaataagtccgtccttcgtacggggtttaccaacgtcgtcttctcgtcgtcctaccaagtcgtcggacgaccaccgggtccctcccgtacgaccactctcgtcggcctaccgaggtcgtaggaacgacggtacggtcgttagaatttattacgtgactacgtctactaattacgtaacgacggtacagaccgtacaccgtacttacggttacgggtttaccggggacgggaacgggtaaccgtaacggtccgtacgggtaacccgttccggtaacggtacccgaacccggtaaccccgaaccgggtaaccccctaacccccgtacgttacccggttaaccccg

SEQ ID NO: 150855 - DNA, 542 bp, Homo sapiens
  misc_feature: GYAE6OF01A69CC.7.5.A05.1.454.CMB.1.raw
  modified_base (246)..(246): a, c, t, g, unknown or other
  misc_feature (246)..(246): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccagcaaacgcccccaaagtcatcatttatgatgtctataatcgcttcgagggtttccaatcgtcttctctgctcaagtctggcgacacggcctccctgaccatctcgtcggcctccgagctagaagacgaggctgatttattacgtgcagctacatactacacggcagcagcacgtcgtacggtttcggacgggtacggaccgaaggtcctacggtacccgttccgtacggtccgacggtacccgaacggccgtccgcccccgtcggtacccg

SEQ ID NO: 150856 - DNA, 730 bp, Homo sapiens
  misc_feature: GYAE6OF01ATGVV.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatcctctgcactggaaccacactgacgttgctaggttaataaatatctctcctggtatacaactaatacccaggacaaacgacccccaaagtcatactatttatgtatgtactataacgtccggcctttacgtacgggtttaccaagttccgtactttctcgtcggtcctaccgtaacgtcgtacggccgtaaccgaccggtccctaccccgtgtaaccctacgttaccgttccgtcggggtcccttacccggtaacgggtaccgtaacgggaaacggtaaccgggtacgggtaccgtttaacggttaacttttaaccgtttaccggtacgtaccgtaacggtccttaaccgtacgttaacgtaaccgaagggtaccaacgaccgtacgtaccgtaccgttacggttacggggttttaccgggacgggtaaacccggtaaccgacggtcccgtaaccggtacccggtcccggtacggtacccgaccggtacccgtacggaccccgtcccggtcccccgtcgggtacccg

SEQ ID NO: 150857 - DNA, 639 bp, Homo sapiens
  misc_feature: GYAE6OF01BC361.7.5.A05.1.454.CMB.1.raw
  modified_base (298)..(298): a, c, t, g, unknown or other
  misc_feature (298)..(298): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctctgcactggaaccacactgacgttgctaggtaataatatctctcctggtatcaacaactacccgagacaaacgaccccaaagtcatcatttangatgtctataatcgcttgtacgggttacaatcgtcttactcgtcggtctacgaagtctacggtcgaccgtaccggtccctacccctaggaccctattcccgttcgtacggtcctcccgaggtcgtacggtaaacgacggtacggtacctaggtaactttagttaacgtcgactacgtcttaccaatacgtaaccgaggtaccagtaccgacgtacctacgttacgttacggggtttacggacgggtaccggtaacgtacggtaccgttacggtaccgttccggttaacgtcccgacgtaccccggaacgtccccgtccggtccccccgttcgggtaacccc

SEQ ID NO: 150858 - DNA, 673 bp, Homo sapiens
  misc_feature: GYAE6OF01DRG6C.7.5.A05.1.454.CMB.1.raw
  modified_base (441)..(441): a, c, t, g, unknown or other
  misc_feature (441)..(441): n is a, c, g, or t
  modified_base (560)..(560): a, c, t, g, unknown or other
  misc_feature (560)..(560): n is a, c, g, or t
  modified_base (651)..(651): a, c, t, g, unknown or other
  misc_feature (651)..(651): n is a, c, g, or t
  modified_base (659)..(659): a, c, t, g, unknown or other
  misc_feature (659)..(659): n is a, c, g, or t
  modified_base (669)..(669): a, c, t, g, unknown or other
  misc_feature (669)..(669): n is a, c, g, or t
tcagcgtgtctctacacgaccggtgctcgatttagatagatagacgaggggggggtctcaggaggcagcgctctcgggacgtctccaccatggcctgggctctgctattcctccaccctcctcactcagggcacgagggtcgtcgggcccagtctcgccctgactcagcctgcctccgtgtcgtgggtctccgtggacagtcgatccaccatcctcctgcacgtacggaaccaccacgtcgtacgttgacgttaggttaataaaacttcttcccttcgtacggttaagtactaacaaaactaaccgtaaccgaaccggaaaccaaccccgtaacccgtaatactacttatttaatagtagtatacttaataacgtcgtccgttacgtacggttacgtactacgtcttcctctcgtcgacctacgtagtcggcgaccgaccncccgtccctacgacacgtcgtcgtccgtcggtcccacgggagttacggaaggaacccggtaggtattacgtaatttactttaaccgcgtcgaactacttaaccgtaactagggtaaccncggggacaaccgagttaacccgacgttagttaccgttaggggtttcggggcggaacgggtacccagtacgtcgacgttcccgaggtcaccnccgagccncgcccgtccncgtc

SEQ ID NO: 150859 - DNA, 626 bp, Homo sapiens
  misc_feature: GYAE6OF01C0XEZ.7.5.A05.1.454.CMB.1.raw
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttaggttaataatntctctcctggtactacaacaatacccaggacaaacgaccccaaagtcatctatttangatgtactataatcgtccttcgtacgggttcaatcgtcttctcgtcgctaccaagtcgtggcgacgacccggcccttcccgtacgacctacttcgtcgtcgggtacctccgaggcgtaggaacgtacggaggtacgttagtactttagttacgtacgctacgtctactaattacgtaacgtacggacgtacggacacgtacctaacgttcggttacgggtttaccggggacggaccgggtacgaacggtccgtacggacccggttaccgtacggtaccgacgacccgacggtccctcccggtccccgtcggttacccg

SEQ ID NO: 150860 - DNA, 712 bp, Homo sapiens
  misc_feature: GYAE6OF01BMUBU.7.5.A05.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtggcccagtctgccctgactcagcctgccttccgtgtcgtgggtctcctggacagtcgatcacntctcctgcactcggaaccacactgacgttgcgttagttaataaattactcttcttcgtagtatacaaacaactaccaggacaaacgaccccaaatcatactattangattgtactataagtccgtccttacgtacgggtttaccaagttccgtcttcctcgtcgtactacgtaagttcgcggacgacgtacccggtacccttcccgtacgtaaccctcgttccgttacgttccgggacctcgtaacgggaccgttagggaaaccggtacggacgggtacttaacggttaactttaaccgtttacgacgttaccgacggttacctataacgttaacgacggacggaccgaggtaccaggccttaaccggtacggtttacggggttaccgggaacgggaaccgggtaaccgtaaacgggtcccgttaacggtaccccggttaccggttacgggtaaccccacgggtacccgaacggtcccgtacccgttccccccggtaggttaccccg

SEQ ID NO: 150861 - DNA, 660 bp, Homo sapiens
  misc_feature: GYAE6OF01BA2BB.7.5.A05.1.454.CMB.1.raw
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgagggggggggttcgtcaggaggcagcgctctcgggacgtctccaccatggcctgggctctgctattcctccaccctcctcactcagggcacgagggtcgtgggcccagtctgccctgactcagcctgcctccgtgtctgggtctcctggacagtcgatcaccatcctcctgcacgtcggaaccaccactgtacgttgcttaggttataaatntcctctcctgtatacaacaataccaggacaaacgccccaaagtcatcatttangtatgtntatactcgtcttcgagggtttccagtcgtcttctctcggactacgtaagtcgtggccgtacgaccggtccctcccgtacgaccctactcctccgtcgggtcctacccgaggtaccttaggaaacggaccggacggtacgttagtaatttaacgttaaccgtgaccgagtcttacaacgttacaacgagggaccaggcgaacgtcctaacgttcgtaacgggtttccgggacgggtaccgggaacctaaggtccgttaccgggacccgttccggttaacgggtacccgtaaccggtaaccccggaagggttcccccgttacggcccccccggttggtaccccg

SEQ ID NO: 150862 - DNA, 597 bp, Homo sapiens
  misc_feature: GYAE6OF01AVXRO.7.5.A05.1.454.CMB.1.raw
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgccccaaagtcatcatttatgatgtctataatcggccttcgaggggtttcaatcgcttctctgctcaagtctggcncacggcctccctcgaccntctctcggctccgagctgaagacgagctagtattattactgcacgctacatactacacgggtcacggacacgtaccaacgttccggtacgggtttttccgggacggggtaaacggggtacccgaacggtccgtagggtaaccccggttccggttaaccgggtccgaacggtacccccggtaaacgggcccgttaccccgggccccccgttcccgggttaaccccg

SEQ ID NO: 150863 - DNA, 698 bp, Homo sapiens
  misc_feature: GYAE6OF01BQBPK.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaacccaccactgacgttgcttaggttaataaatntctctcctggtatcaacaactaccaggacaaacgcccccaaagtcatctatttatgatgtctataagtcggtccttcgtacgggtttccaagtcgtctttctctggtcctccgaagttcgtggccgaacgaccggtccctcccgtcgaaccctattcgtcgtcgggcccttcccgacggtcgttacggaaacggaacggacggtcgttagtaatttaacgtttacgtcgactacgtccttacgtaacttaacgtaccgaacgggacgtaacggctaacggtccctaaccgttacggttacggggttttaccggggacgggtaaccggggtaacccgtaacggtccgttaccgggtaacccggttcccggtaacgggtacccgtaacccggaccccggtaacgggtaccccgttcccccggtaccccccggttcgggttaaccccc

SEQ ID NO: 150864 - DNA, 798 bp, Homo sapiens
  misc_feature: GYAE6OF01CB7Q1.7.5.A05.1.454.CMB.1.raw
  modified_base (214)..(214): a, c, t, g, unknown or other
  misc_feature (214)..(214): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcgagggcacgagggtcgtcgggcccagtctcgccctgacctcagcctcgcctccgtgtctgggtctccgtggacagtcatccaactntcctcctgactacgtacggaaacccacgtacgtcggtacgttgacttaggttaataaattctccgttctccgtagtaactacaactaacgtaacccgaaggaaccaaaccgaaccccctaaagtactacttactaagttttagacgtattacgttacttaagttaaccgtccggttaccgtttaccggttaacgggtttaccctaacgttccgtctttacgtcgtaccgtaccttacgtacggtacgtcgggaaccgaccgtacccggtccccttccgtacgtaacctcgttacccggttccggtccgggccttacggacgggttacgaaacgggaacggaccgggttacgagtttacgttaacgttactttaaccgcggtaactaccggtaacctaacttaaccgttaacgaaccgacggaccgagttaaccgagttaccgtacccggttaggtaccggggttaccgggaacgggtaaccgggaaactccgggttacggtacccgaacccgggtttaccggaacggtccggaacccgtaccgggacggttaccccgtcccggttacccccggtcggttaaccc

SEQ ID NO: 150865 - DNA, 632 bp, Homo sapiens
  misc_feature: GYAE6OF01BKNX4.7.5.A05.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
  modified_base (496)..(496): a, c, t, g, unknown or other
  misc_feature (496)..(496): n is a, c, g, or t
tcagcgtgtctctacacgaccggtgctcgatttagatagatagacgagggggggggttctcgaggaggcagcgctctcgggacgtctccaccatggcctgggctctgctattcctcaccctctcactcagggcacagggtcgtcgggacccagttctcgacccgtgactcagcctgcctcgtgtctgggtctcctggacnggtcatcacctatcctcctgcactcggaaccacatgacgttgcgttagttaataaatcgtctctccgtaggtactacaactactaccgagacaaccgaccctaaagtctatactatttanagtattgtactatacgtccgtcttacgtacgggtttcaagttccgtcttcncgtcggctacgtacgtcgtcggaccgaaccgtccggtccctccgtacgtaacctcttccggtcggtccggtaccttccggacgtacgtaacggaacggacgtagtcttagtacgtttacttacgngtacagtctatagtactacgacgcacgactacgactcgttacggtcggtacgggtacggaccgaacgtacgtccgtaccggaccgttacgacggtaccgaccgtaccgacgtccctaccggtcccgtcgtaacccg

SEQ ID NO: 150866 - DNA, 606 bp, Homo sapiens
  misc_feature: GYAE6OF01CN9WD.7.5.A05.1.454.CMB.1.raw
  modified_base (296)..(296): a, c, t, g, unknown or other
  misc_feature (296)..(296): n is a, c, g, or t
  modified_base (390)..(390): a, c, t, g, unknown or other
  misc_feature (390)..(390): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatctcctgcactggaaccaccactgacgttgcttggtaataatatctctcctgtactcaacaatacccagcaaacgccccaaagtcatcatttangatgtatataatcgtcttcgagggtttccaagtcgtcttctcgtgctcctaagtcgtcggcgacgaccggcctcctgaacctatcgctcggtcnccgtacgcgtagaacgacgacggctgtaatttaacttacgtcgctagtctacgtaatagtaactaggacacgcgtacgactaccgttcgttacgggttttaccgggacgggtacgggaaccgtaacggtaccgtaacggtacccggttaccggttaacggtaccgtaccggaacccgtaccgggacccgttcccggcccccgttacgggttccccg

SEQ ID NO: 150867 - DNA, 686 bp, Homo sapiens
  misc_feature: GYAE6OF01DD277.7.5.A05.1.454.CMB.1.raw
tcagcgtgtctctacacgaccggtgctcgatttagatagatagacgaggggggggtctcgaggaggcagcgctcgtcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgacgtttgacgttggttaataaatctctctccgtagtactacaacaactacccaaggacaaacgaccccaaagtcatctaatttatgtatgtactattaactccggtactttcgtaggggtttaccaagttcgtctttctcgtcggtcttacgaacgtcgtaggccgaaccgccggtccccttcccgtacgtaaccctacttccgtcgttacggggtcccttacggaacggtacgtaacggaacggacggtaggtaccgttagtattttaacgttacgtacgacgtactcgtactaagtaacgtaacgacggcaacggtccagtcctaacgttcgttacggggtttaccggacggggacggtaaccgtacggtaccgtacggtaacccgttccggtacggtaccgaaccggtacccgtaacggtccccgtacccgtcccccgttccgggttaacccg

SEQ ID NO: 150868 - DNA, 611 bp, Homo sapiens
  misc_feature: GYAE6OF01ANH8W.7.5.A05.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
tcagcgtgtctctacacgaccggtgctcgatttagatagatagacgagggggggtctcaggaggcagtcgctctcgggacgtctccaccatggcctgggctctgctattcctcacctctcactcaggcacagggtcgtgggccagtctgcctgactcagcctgcctcgtgtctgggtctcctggacagtcgatcaccatctcctgcactggaaccncactgacgttgctggttanaaatntctctctggtaatctaacaatacccaggcaaacgccccaaagtcatcatttangatgtctatatcggcttcagggtttccaatcgcttactctggctcgaacgtctggcgacacggcctccgtgaccatctcgtcgggactccgagggtcctaggaacgacggaggtcctagacttacgttaacgtgtacagctacaagttacgtacgaacgggactaggcgaacgccgtaacttacggtaacgggttttccggaccgggttaaagggaaccccaaagggtcccgttacggtaacccggttcccgttaaacgggttcccaaacggtaccccgtaaagggtccctaccggtaccccccgtcgggttaacccc

SEQ ID NO: 150869 - DNA, 552 bp, Homo sapiens
  misc_feature: GYAE6OF01DS1J8.7.5.A05.1.454.CMB.1.raw
  modified_base (251)..(251): a, c, t, g, unknown or other
  misc_feature (251)..(251): n is a, c, g, or t
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgctggttaataaatntctctcctggtatcaacaatacccaggcaaacgccccaaagtcatcatttatgatgtactataatcggtccttcaggggtttccaatcgtcttctcgtgctccaagtctggcgacgaccgcctccctgaccntcgtctggctccagctagaagacgaggctgtattattactgcgagctcatanacaggacagcacgcacgttcgtagggttttccggacgggacggacgaacgtcgtcggtacccggtccgtacggtcaccggtacccgacgtccgtcccggtccccgtccggttacccg

SEQ ID NO: 150870 - DNA, 750 bp, Homo sapiens
  misc_feature: GYAE6OF01B38GK.7.5.A05.1.454.CMB.1.raw
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctccgtggacagtcgatcacntctctgcacgtgaaccncactgacgttgcttagtaataatctctctctgtacacaacaactaccgaggaccaaacgaccccaaagtcatacgtatttangtatcgtataactaagtccggtcttcgtacgggtttaccaagttccgtcttcgtcgtcggtactacaagttcgtcggacgtaccgaccggtccctaccgtacgacctacgtccgtcgtcggtcctaccgacgtacgtacgaaacggacggtacggtacgttacggttacgtttaacgtttaacgtacggtacctaacggtacctacgtaaacgttaaccgttaacgaacgggttaccgaaaccgggtaccgtaaaccggtaccttaacccgggtttacgggttaacggggttttaccgggggaaccgggtaaaccgggtaacccggtaacggttcccggtacccggttaacccgggttacccggtaacgggttaccccggtaaccggtaccccggtaacggtacccccggttaccccggttccccccggtaccggtttaacccccg

SEQ ID NO: 150871 - DNA, 603 bp, Homo sapiens
  misc_feature: GYAE6OF01E1SF0.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctgttaataatatctctctggtatacaacaatacccaggacaaacgcccccaaagtcatcatttatgatgtactactaatcgccttcgtacgggtttctaatcgtcttctactggactccgaagtctaggaccgacgaccggccctccctcgacctactctcgtcgggccttccgacggcgtagaacgacggaggccgtagatttaattacgtgcacgctcatactacgaggcagcacgtacaccgttcgtaggtttccgggacgggtaccgggaaccgaaccggtccgtacggtaccccgttccggttaccggtcccgaccggtaccccgtaacggtacccgttcccgcccccggtccggttaccccg

SEQ ID NO: 150872 - DNA, 664 bp, Homo sapiens
  misc_feature: GYAE6OF01A6UP7.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcaccatctcctgcactggaacccaccactgacgttgctggttaataaatatctctcctggtatcaaacaatacccaggacaaacgacccccaaagtcatctatttatgattgtctaataatcggccttcgagggtttccaatcgcttctctggctacgaacgtctggcgaccgacggccctccctacgacctatcctacgtcgggccttccgaggtcgtagaaacggacgacggaccttagactttaacttacgtagtccacggtacttacaattacgtaaccgacggtaccgtacggacctaacggaccttaaccgttaccggttaacggggttttacggggaccggggtaaacggggtaaccccaaagggtcccgttaccggaaccccggtttacggaaccgggttccaacccggacccgttaacgggcccttccccgggtcccccgttcggtttaaccccg

SEQ ID NO: 150873 - DNA, 578 bp, Homo sapiens
  misc_feature: GYAE6OF01EIKJH.7.5.A05.1.454.CMB.1.raw
  modified_base (247)..(247): a, c, t, g, unknown or other
  misc_feature (247)..(247): n is a, c, g, or t
  modified_base (450)..(450): a, c, t, g, unknown or other
  misc_feature (450)..(450): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgctggttaataaatntctctctgtatcaacataccaggacaaacgcccccaaagtcatctatttatgatgtctataatcgtcttcgtacgggttccaatcgtcttctcgtcggtctcaacgtctaggccgtaacgaccggtccctcccgtacgacctactcctcgtcgggcctccgaggctagaagacggagtcgtagtatttacttacgtgtaccgntactacgaattaacgtaacaggacagacacgacacgtcgtacggtttcgggcggaacggaaccgagtccgtacggaccgttcgacgtacgaccgtacccgacggtcctccgcccccgttcggtacccg

SEQ ID NO: 150874 - DNA, 536 bp, Homo sapiens
  misc_feature: GYAE6OF01EZFGJ.7.5.A05.1.454.CMB.1.raw
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactggaaccaccactgacgttgctggttataaatatctctcctgtatcaacaataccaggcaaacgacccccaaagtcatcatttatgatgtctaataatcggtccttcgtacggggtttccaatcgtacttctctgctcaagtctggcgacacggcctcctgaccatctcgtcgggctccagctagtaagacgaggntagtattattactgcagctacgataatacgaaggtcagcancactacgtaggtttcgggacgggtacgggacgaacgtgtgaccgtccgtacggtcacgacccgaaggcctccgcccccgtggtaccc

SEQ ID NO: 150875 - DNA, 837 bp, Homo sapiens
  misc_feature: GYAE6OF01DL3YG.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacctatctcctgccacgtacggaaccaccactggacgttgcttggttaataaatntctctctgtatacaacaataccagacaaacgcccaatcatctatttatgtatgtactataacgtcggtcctttcggtaagggttcctaatccgtcttcctcgtcggtacctaccgtaacgttccgtacggaccgtaccgtacccggtccccttacccgtacgtaaccccgttattacccgttccgggttacgggtacccgttaccccggtaacgggtccccgttaaagggaaacccgggtacggggtaaacgggtccgtttacgggtttaaccgtttttaacgtttaacccggttacggaccgttaccgggtaccctttaacgttaacttaaccgttaaaccggaaccggggaacgtaaccgggtaccgtaaccggtacccgttaacccggtttaccgggtttaacggggggtttttaccccggaaccgggggggtaaaccgggtaaacccgttaaacgggtcccgtttaacccgggtaacccggtttacccgggtaaaccggttacccggacccgggtaaacccccggaaacgggtttcccccggaacccccggttccccccgggttaccggttaaccccgg

SEQ ID NO: 150876 - DNA, 723 bp, Homo sapiens
  misc_feature: GYAE6OF01B94CP.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctctgcactgaaccacactgacgttgcttggttaataaatatctctccgtggtactcaaacaatacccaggacaaaaccgaccccaaaagtcactactaattttacgtgaattgtacttataaagtccggtacctttacgtacggggtttaccaattccgtctttccgtcttggccttacgaacgttcgtcggacgaccgtaccggtaccctcccgtcgaccctactctccgtcgggtcctccgacgggtctaggaaacggtacggacgggtccgttagtaacttttagtttaacggtccgtacgtacggtaccttctaacttaacgttaccgaggtaacccgaagtcccgaacgaccgttaacgttaccggttaaggggttttacccgggacggggaaccgggtaaccccgtaaagggtcccgttacgggtaaaccccggttcccgttaacggggtacccaacgggtaccccgtaaacgggtcccgtaccccggtccccccggttacggtaacccccg

SEQ ID NO: 150877 - DNA, 552 bp, Homo sapiens
  misc_feature: GYAE6OF01A4FWA.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaagcccccaaagtcatcatttatgatgtctataatcggcttcagggtttccaatcgcttctctgctcaagtctggcgacacggcctccctgaccatcttcgtcgggtctccgacggctaggaacgacgaggctaggtatttattactgcagctacatatacaggtcagcgagccactacgtacggttttcgggcgggtaacgggaccgtaaggccgtaggacccggttccgtacggtccgacgtacccgaacggcctccggtcccccgtcggtacccg

SEQ ID NO: 150878 - DNA, 768 bp, Homo sapiens
  misc_feature: GYAE6OF01BVGSI.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcttgcctccgtgtctgggtctcctggacagtcgatcaccatctcctgcactcggaaccaccactgacgttgcttaggttaataaatntctctcctgtatacaacaactaccagacaaaccgaccccaaagtcatactatttatgtatgtactaattaacgtccggtacctttcggtaacgggtttaccaacttccgtacctttcgtcgtcggtcctaccgtaacgtcgtcggtaccgaccgtacccggtccctacccgtacgaacccttacgttcgttaccggtccgggtcccttacccggtacgggtaccgttaacgggaaaccgggtaaaccggtacgggttaccgttacggttaaacgttttacgttaaccgttcgtaccgtaacggtacctttacgtaaacttaacgtaaccggtaggtaccctaaggaccgtaacgtaccgtaccgttaccgggttacggggtttaccggggaaaccggggtacgggtaaacccgtacggtaccggttacccggtaacccggttccggtaacggtacccgtaacccggtaaccccgaagggtccccgttaccccggtacccccggttccggtaaccccg

SEQ ID NO: 150879 - DNA, 624 bp, Homo sapiens
  misc_feature: GYAE6OF01EB6E4.7.5.A05.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgcttggttataaatntctctcctggtatcaacaatacccaggacaaacgccccaaagtcatcatttangatgtctataatcggtccttctaggggtttccaatcgcttctctggctacagtctggcacaccggcctccctgaccatctcgtcggcctccgagcgtagaagacggacggtcgtagtatttaacgttactcgtacacgtctacgtattaacgtaacgtacggacgagacctaacgcctaaccgtaccggttaacggggttttcccgggacgggtaaccgggaaccgtaaggtaccggttacggacccggttaccgtaacgggtacccgaaccggtacccgtaaacgggtcccttacccgggtcccccgttcggttaaccccg

SEQ ID NO: 150880 - DNA, 680 bp, Homo sapiens
  misc_feature: GYAE6OF01ENRM1.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctctgcactcggaaccaccactgacgttgcttaggttaataaactntctctcctggtatcaacaatacccagacaaacgccccaaagtcatctatttatgtatgtactaataagtccggtcttacgtacgggtttccaatcgtccttcgtcgtggctccaagtcgtggacgaccgacggtccctcccgtcgacctacttccgttcgtcgggtccttacccgaggtccgtaggaaacgacggacggtcttaggtaatttacgttaactcggacaggtcctactattaataccgaaggcacgcgtaacgacgtacgttaccgtttaacggggtttccgggaaccggggaaccgggaaacccgtaaaccgggtccgttaccgggtaaccccggttcccgttaaacggggtccctaaacccggaccccggtaaacgggtccccgtaccccggttaccccccgtcgggtttaaacccccg

SEQ ID NO: 150881 - DNA, 609 bp, Homo sapiens
  misc_feature: GYAE6OF01ANE4U.7.5.A05.1.454.CMB.1.raw
  modified_base (364)..(364): a, c, t, g, unknown or other
  misc_feature (364)..(364): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggacaaacgcccccaaagtcatctatttatgatgtactataatccggccttcgtagggtttccaatcgtcttctctgctcaagtctggcgacncggcctccctgaccatctcgtggcctccgagctagaacgacgaggctagtatttattacgtgccgtagtcctactaacttaataacgaacggtacgagaccgtaacgaccgtaccgttacgttacggggttttaccgggaccgggtaacgggaaccgtaaaggtcccgtacgggtaccccgttccggtaacggtccgaaccggtaccccgaacggtcccgtcccggtccccccgttcggtacccc

SEQ ID NO: 150882 - DNA, 559 bp, Homo sapiens
  misc_feature: GYAE6OF01BRZHM.7.5.A05.1.454.CMB.1.raw
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttaggtttaataaatatctctctggtatcaacaataccaggacaaacgccccaaagtccatctatttatgtatgtctaataactcgtccttcgtacgggttcctaatcgtcttctcgtgctcgaagtcgngcgacnccgcctccctagaccgtatccgtcgtcggcctacgacggtctaggaagacggaggcttagatttatactagcagtctgtaatataacgaggtcagtcagctacgtcgtacggtttcggacgggacgaccgacgcgtcgaccgtccgagtaccgaccgtaccgacggtcctcccgtcccgtcggtaccc

SEQ ID NO: 150883 - DNA, 672 bp, Homo sapiens
  misc_feature: GYAE6OF01EBYVJ.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatcctcctgccacgtcggaacccaccactgacgttgcgttaggttaataaatctctctcgtgtatcaacaatacccaggacaaacgccccaaagtcatctatttatgatgtactataatcggtccttgtacgggtttccaatctcttctcgtcgtctaccgaacgtcgtcggaccggtaccgaccggtcccctacccgtacgaccctacgttcctacggtcggtcctacccgtaggtccgtaggaacggacgagggtcgtacgtatttaacttacgtacgtcgtacggtctagtaacttacgtaacgacggacaggtacctacgacgtaacgtcgggttaacggtttccggggaacgggtacgggaaccctaggtacccgtacggtaacccggtaccgttaaccgggtccgaaaccggtaaccccggtagggtacccccgtaccgttccccccgtcgggttacccccg

SEQ ID NO: 150884 - DNA, 680 bp, Homo sapiens
  misc_feature: GYAE6OF01EUMZD.7.5.A05.1.454.CMB.1.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctcgtgtctgggtctcgtggacagtcgatcaccatctctgcacgtcgaaccacactgtacgttgctagttaataatntctctcgtgtactacaacaactaccagacaaacgaccccaagtcatactatttanagtatgtactaagtacgtccggtccttacggtacgggtttacctaacgttccgtcttctcgtcggtacctacgtaacgttcgtcggaccgtaccgtacccggtccctcccgtacgtacctacttccggtcgtccgggtcctaccggtaggtacgtaacggaacggtacgggaacgtacgttagttaactttaacgttacgtcgtacgtacgtacttacgaactacgtacgaacggtacacggtacacgacgttacgttacgggttacgggtttacgggacgggtaaccggtaacgtaccggtacgtacggtacccgttacggtaccggtaccgaccggtaacccggtacgtcccgtacccggtccccgtcgtaccccg

SEQ ID NO: 150885 - DNA, 729 bp, Homo sapiens
  misc_feature: GYAE6OF01AB504.7.5.A05.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatcctctgcactcggaaccncactgacgttgcttggttaataatntctctcctgtatcaacaactaccaggacaaacgcccccaaagtcactctatttangtatgtactataacgtccgtccttcgtacgggtttaccaacgttcgtcctttctcgtcggtcctaccgaacgttctacgggccgtaacgaccggtccctacccgtacgtaccacttccgtacgtcgggcctacccggaggtcgtacggtaaacggacggtacggtaccgttaggttaacctttacgtttaccgcggtacctacggttacctaactaacgttacgtaacgtaccgggacaacggtaccgaccgtaccgtaaccgttacgggttaacgggtttacccggggaacgggtacccgggtaaaccgtaacccggggttccgtacccgggttaacccgttcccgggttaacggtaaccccgaccgggtaaccccggtaacgggtccccctacccccgggttcccccgttaccggttacccccg

SEQ ID NO: 150886 - DNA, 596 bp, Homo sapiens
  misc_feature: GYAE6OF01EWVX7.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcacccctcctcactcagggcacagggtcgtgggcccagtctgccctgactcagcctgcctccgtgtctgggtcctccgtggacagtcgatcaccatctcctgcactgaaccaccactgacgttgctggttaataaatatctctctgtatacaacaactaccagacaaacgccccaaagtcatctatttatgatgtactatagtcgtcttgtaggttcatcgtcttctctcgctacgagtctcggacgacgacgtccctacctcgacctgtccttcggtacggtcctaccgacggtacgtaggaacgacggaggcttagtatttattacgtgacgtactacgtactagtatacgaggacgagacacgactacgttacggttacgggttccgggacgggtacggaaccgtagccgttacggacccgttccggtacggtaccgaccgtacccggtacggccctccccggtccccgtccgttaccccg

SEQ ID NO: 150887 - DNA, 571 bp, Homo sapiens
  misc_feature: GYAE6OF01DO65R.7.5.A05.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (491)..(491): a, c, t, g, unknown or other
  misc_feature (491)..(491): n is a, c, g, or t
tcagcgtgtctctacacgaccggtgctcgatttagatagatagacaggggggggtcgtcaggaggcagcgctctcgggacgtctccacatggcctgggctctgctattcctcacctcctcactcagggcacagggtcgtgggcccaggtctggccctgactcagcctgcctcgtgtctgggtctctggacagtcgatcaccntctccagcactggaaccnctacgtgacttgctggttaataaatgtctctccgtatcaacaataccgacgagaaactacccaacgtacatactagttatgangtacttataaatccgcgttctagggttcgtaacncgtcttctcgttcgcgtcctaacgtcgtcggccgactacggcctcccgtacgacaactcgttctcgggacgcctagggctagagacgngcgttnagttaactntcgcagctnactagaacnggaccntaccagactctacgtagggtttccggngggacgaaccggaatcggtcgaccggtaccgttacggctacgacccgacggtcgttcccaccccggttccggactacccg

SEQ ID NO: 150888 - DNA, 547 bp, Homo sapiens
  misc_feature: GYAE6OF01AX3I8.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatntctctcctggtatcaacaatacccaggacaaacgccccaaagtcatcatttatgatgtctataatcgccttgagggtttccaatcgcttctctgctcagtctgcgacacgcctcctgacctatctcgtcgggctccgaggctagaacgacgacggctagatttattacgtgcagctacatactacgaggcagcacgctactcgtacggtttcggacgggtacggaccgtaggccgtacggacccggttccgtacggtaccaccggacccgaacggtccgtcccgtccccgtcggtacccg

SEQ ID NO: 150889 - DNA, 564 bp, Homo sapiens
  misc_feature: GYAE6OF01BASDM.7.5.A05.1.454.CMB.1.raw
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaatntctctctggtatcaacaataccaggacaaacgcccccaaagtcatcatttatgatgtctataatcggccttctagggtttcaatcgcttctctgctcagtcnggcgacacgcctccngaccatctcgtggctccgaggtcgtagaacgacggagctagtactttattacgttcgactgtctataatactacgacggtacagcacgcacgttaccgttagggtttccggacggggtaggaaccgtaacgcgtacggacccggtccgtacggtaccgacgtacccgaacggtccgtcccggtcccccgtcggtacccg

SEQ ID NO: 150890 - DNA, 587 bp, Homo sapiens
  misc_feature: GYAE6OF01EB2N1.7.5.A05.1.454.CMB.1.raw
  modified_base (249)..(249): a, c, t, g, unknown or other
  misc_feature (249)..(249): n is a, c, g, or t
  modified_base (359)..(359): a, c, t, g, unknown or other
  misc_feature (359)..(359): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgcttggttaataaatntctctcctggtatcaacaatacccaggcaaagcccccaaagtcatcatttatgatgtctataatcggtcttcgagggtttccaatctcttctctgctcagtcgtgcgacncggccctcctcgacctatcctcgtcggcctccgacggtctagaacgacgaggtctagtatttacttacgtgcgtacgctctaatactacgacggacagccaagtctacgttaccggtagggtttccgggacgggtaccgggaaccgtaacgtccgtacggtacccggttccgtacgggtaccaccggtacccgaacgggtccctcccggtcccccgtcggttaccccg

SEQ ID NO: 150891 - DNA, 544 bp, Homo sapiens
  misc_feature: GYAE6OF01AGKVW.7.5.A05.1.454.CMB.1.raw
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaatacccaggacaaacgcccccaaagtcatcatttatgatgtctataatcggcttcgtagggttcatcgcttctctgctcagtctgcgacncggcctcctnaccactctcgtggctcgcggctagaagacggacggtctagtacttacttactcgctacgtctcactacgtacgaggcgagcacgcacgtcgtacgggtttcggacgggacgggacgacggtcgtacggacccggtccgtacggtcgacgacccgacggcctccggcccccgtcggtaccc

SEQ ID NO: 150892 - DNA, 613 bp, Homo sapiens
  misc_feature: GYAE6OF01A6YMW.7.5.A05.1.454.CMB.1.raw
  modified_base (251)..(251): a, c, t, g, unknown or other
  misc_feature (251)..(251): n is a, c, g, or t
  modified_base (383)..(383): a, c, t, g, unknown or other
  misc_feature (383)..(383): n is a, c, g, or t
tcagcgtgtctctacacgaccggtgctcgatttagatagatagacgaggggggggtctcaggaggcagcgctctcgggacgtctccaccatggcctgggctctgctacttcctcaccctcctcactcagggcacagggtcgtgggcccagtctgccctgactcagcctgcctccgtgtctgggtctcctggacagtcgatcaccatcctcctgcactcggaaccaccactgacgttgctggttaataaatntctctcctggtactcaacaatacccaggacaaacgcccccaaagtcatctatttatgatgtatataatcgtcttcgtagggttccaatcgcttctctggtctcagtcgtcggcgaacgcgcctcctgacctntctcgtcggctccgagtcgtagaacgtacggaggtcttaggtaactttagttaccgtgacctagtcctactaacgttactaacgacggtacgacgtacaacgccgtaacgttcggtacgggtttccgggacgggacgggaacctacggtccgtacggtacccgtcccggtacgggtaccgaaccggtacccggaacggtccccgtacccggtcccccgttcggtaccccg

SEQ ID NO: 150893 - DNA, 590 bp, Homo sapiens
  misc_feature: GYAE6OF01EV9GV.7.5.A05.1.454.CMB.1.raw
  modified_base (252)..(252): a, c, t, g, unknown or other
  misc_feature (252)..(252): n is a, c, g, or t
  modified_base (381)..(381): a, c, t, g, unknown or other
  misc_feature (381)..(381): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccacgtgacgttgcttaggttaataaatntctctcctggtatacaacactaccagacaacgaccccaagtcatcatttatgtatgtactatacgtcggtcttacgtacgggtttccaatcgtcttctctcgctccagtctggcgacacggtcctcccnaccatcctcgtcggcctccgagctagaacggacgagtcgtagtattacttactcgactacgtctactataacgtacgagacaggacctagacctacgttaccgtagggtttccgggacgggtacgggacccgaaggtccgtacggtacccggttccgtacgggtaccaccggtacccgtacggacccgtcccgtcccccgtggtacccc

SEQ ID NO: 150894 - DNA, 670 bp, Homo sapiens
  misc_feature: GYAE6OF01DKW15.7.5.A05.1.454.CMB.1.raw
  modified_base (314)..(314): a, c, t, g, unknown or other
  misc_feature (314)..(314): n is a, c, g, or t
  modified_base (408)..(408): a, c, t, g, unknown or other
  misc_feature (408)..(408): n is a, c, g, or t
tcagcgtgtctctacacgaccggtgctcgatttagatagatagacgagggggggggtctcaggaggcagcgctctcgggacgtctccaccatggcctgggctctgctattcctcacccctcctcactcagggcacgagggtcgtgggcccagtctgccctgactcagcctgcctcgtgtctgggtctccgtggacagtcgatccacctatcctcctgcacgtcggaaccaccactgacgttgtcgttaggttaataatatctcttcctggtatacaacaactaccgagacaacgaccccaaagtcatctattangatgtataatacgtcgtccttagacgggttccaatccgtcttctcgtcgtactacaagtcgtaggccacgtaccgtccctaccgtacgaccctntaccgtcgtcggcctacgacggtactacggaagacggaggtctagttaacttacgttacgtgactacgtactactacttaacgacgtacggacacgacgaacgaccttaccgttacggttacgggtttaccgggaacgggtaccgggaaactaacgggtccttaaccgggtacccggtttaccggtaaccgggttaccgaacccgggtaaccccggtaaacggtccccgttcccccggtccccccggttccggttaaccccg

SEQ ID NO: 150895 - DNA, 673 bp, Homo sapiens
  misc_feature: GYAE6OF01CIHAN.7.5.A05.1.454.CMB.1.raw
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatctctctcctggtatcaacaactaccaggacaaacgccccaaagtcatcatttangatgtactataatcggtccttacgacgggtttcaactcgtcttctctggctcaagtctggcgacacggccctccgtnaccattccgtacgtcgggtccctaccggaggtctaagggtaacggacggtaacgggtctacggttaacttttaacttaacgtcgtaccgtacgtccctacgtaacttaacgtaaccgaagggtaccaacggactaacggaccttaacgttacccggttaaggggttttccggggaccgggtaacggggtaaccctaacggtccgttacgggtaaccccggttacccgtaacggggtaccctaaccgggacccctaaacggggtccctacccgggtccccccgttcgggtaccccg

SEQ ID NO: 150896 - DNA, 698 bp, Homo sapiens
  misc_feature: GYAE6OF01A3WV5.7.5.A05.1.454.CMB.1.raw
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagcgtgtctctacacgaccggtgctcgatttagatagatagacaggggggggtctcaggaggcagcgctctcgggacgtctccaccatggcctgggctctgctattcctcaccctctcactcagggcacagggtcgtgggcccagtctgccctgactcagcctgcctccgtgtctgggtcctccgtggacagtcgatcaccatcctcctgcacgtcgaaccaccactgacgttgctggttaataaatntctctcctgtatcaacaactaccagacaaacgccccaagtcatctatttangtatgtactataagtccggtccttacgtagggtttcccaatcgtcttctcgtcggtcctacgtaacgtctcggaccgacgtaccgcccttaccccgtcggaaccctacgttccgttaccgtcgggtccttacccggacggtcgtaacgggtaaacggaacggtacggttacgttacgttaagtttaacgttaccgtcgtaccgtacgttaccgtactaaactacgttaaacgacgttacgaacgtaccgtacgacgttaaccgtacggtttacggggtttaccggaccggggtaacggaaacccggtacggtaccgtaccgggttacccgtccggttacgggtaccctacccgggacccgtaacggtccccacccgggttccccgtaccgttccccg

SEQ ID NO: 150897 - DNA, 613 bp, Homo sapiens
  misc_feature: GYAE6OF01EZ9X0.7.5.A05.1.454.CMB.1.raw
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgccactcggaaaccaccactcgacgttgcttaggttaataaatntctctcctggtatacaaacaactaccgaggaccaaacgcccccaaagtcatcattttangatgtactataactcgcttcggtagggtttccaagtcgtcttctcgtggctacgaacgtcgtcggccgaactccggtccctacccgtcgaacctacttcctcgttcgggccttccgaggctagggaaacgacggtaggtcgtagtaatttacttacgtgactagctacatacgtaacgagcgagtccacgacgtacttacggtagggtttcggacgggtacgggaacctaacgcgttacggacccgttacgtacggtacacggacccgtaacggccgtccccgtccccgttcggtacccg

SEQ ID NO: 150898 - DNA, 619 bp, Homo sapiens
  misc_feature: GYAE6OF01CO49K.7.5.A05.1.454.CMB.1.raw
  modified_base (297)..(297): a, c, t, g, unknown or other
  misc_feature (297)..(297): n is a, c, g, or t
  modified_base (598)..(598): a, c, t, g, unknown or other
  misc_feature (598)..(598): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacgagggtcgtggcccagtctgccctgactcagcctgcctcgtgtcgtggtctcgtggacagtcatccacatctctgcacgtcgaaccacactgacgttgcttagtaataatctctctcctgtactacaacaactaccagacaaacgaccccaagtcatctatttantatgtactatagtcgtcttcgacgggttccatcgtcttctcgtcgtctaccgagtccgtcggaccgaccgtacccggtcccttcccgacgaccttacgttccgtcggtcgggtccctccgtacggcgtaacggaaaggaccgacggtcttaagtatttacttacgtgactacgtcctaacattaacgtaaccgaggaccgagacctagtacctaccgttcggttacgggttccgggacggtaccggacaacggtccgtacgtacccggtacctacggtacgaccgtacccgaacggtcccncccggtccccgtcgttacccg

SEQ ID NO: 150899 - DNA, 757 bp, Homo sapiens
  misc_feature: GYAE6OF01D9DAP.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcaccatcctcctgcactcggaaccaccactgacgttgacttggttaataaatatctctctggtatacaacaactaccaggacaaacgaccccaaagtcatctattatgtatgtactataacgtcgtccttacgtacgggttaccaagtcgtcttctcgtcgtctacaacgtcgtcggacgaccgacccggtcctcccgtacgaaccctacgttaccgttcgtacgggtcctacccggaacggtcgtaacggaacggtacggacggtaccgttagtaacttttaagttaccgtagtaccgtacgtaccgtttaacaacgtttaacgtaacggtaacggcgaaccgtacgaccgtacccttaaccgttaccgggtttaacgggggtttaacccgggggaaccggggttaaccgggaaacccggtaaacccgggtaccggtacccgggttaacccccgggttacccgggttaaaccggggtaccccgtaaaccgggtaccccccggttaaagggtccccccgttacccccgggttccccccgttacccgggttacccccg

SEQ ID NO: 150900 - DNA, 717 bp, Homo sapiens
  misc_feature: GYAE6OF01DCGQG.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctctgcactggaaccacactgacgttgctaggttaataaatctctctcctggtatacaacaatacccaggacaaacgccccaaagtcatcattatgatgtactaataactcggtccttcgtagggtttaccaagtccgtcgtttcctcgttcggcttaccgtaaacggttcgtacggacgtaaccgaacccggtcccgttaccccgttacggaaccctaacttccgttaccggttaccgggggcccctttaacccggaacggggttccgtaacgggtaaaacgggtaaccgggaacggtacggttaaccggttaaattttaacggttttaaccgcggttaccgaaggtcccttaaccggtaataaacgttacccgaaggggaccaacgggtacctaaggacccttacggtaccgttacgggttttccgggaacgggacggtaacgaacggtcgtacgacccgttccgtaggtaccaacgcccgaaaggcccgttccgacccccgtggttaccc

SEQ ID NO: 150901 - DNA, 633 bp, Homo sapiens
  misc_feature: GYAE6OF01B5XJ0.7.5.A05.1.454.CMB.1.raw
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (484)..(484): a, c, t, g, unknown or other
  misc_feature (484)..(484): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttaataatatctctccgtgtatcaacaatacccaggacaaacgccccaaagtcatcatttangatgtntataatcgtcttcgtagggttccaatcgtcttcgtctcggcctaccgtaagtcgtcggcgaccgacccggtcccttccctcgaccctactccgtcgtcgggcctccgacggtctaggaacggacgtaggcctagtatttacttaccgtgcagtctacgaactagtacgagcaacgngacgtaccacgttacgtagggttttcccggggcgggtaaaccgggtacccgtaaggtccggttacccggaacccgggtttcccggtaccgggttaccgaccggtacccccgaaggtcccgtaccccggtccccccgtcggttacccccg

SEQ ID NO: 150902 - DNA, 631 bp, Homo sapiens
  misc_feature: GYAE6OF01EIH5A.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgccactggaacccaccactgacgttgcttaggttaataaatntcctctcctgtatacaacaactaccaggacaaacgcccccaaagtcatctatttatcgatgtatataatcggccttctaggggtttccatcgtcttctctcggctccaagtcgtggcgacacggtccctcctcgacctacttcgtcgtcgggacctcccgagtcgtacggaaacgacggacggtacgtacgtactttaacgttacgtagtacctacgcttacattaactacgacggcacgtccgacgtacgaccgttcgttacggggtttcgggacgggtacgggaaccgtacggtccgttacggtacccggttccgtaaccggtacccgaccgtcccggtaaacggtccccgtaccgtccccccgtacgggtacccc

SEQ ID NO: 150903 - DNA, 865 bp, Homo sapiens
  misc_feature: GYAE6OF01CVPM1.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtcctccgtggacagtcgatcaccatctcctgctacgtcggaaacccaccactaggtaccgttgcgttaagggtttaaacttaaaattacttccttccgttacccgttagggttaactaccgaaaactaaacgttaaccccgaaggggaccctaaaaccgaccccccgtaaaaggtcctaacttaccttaattttaacgtagtaacgttcggttaacttaaagttaaaccgttccgggttaacccttttaccgggttaacgggggttttaaccctaaacggtttccggttaccgttttaccgttaccgttacggggtacccttaacccggtaaacggtttccggtaaccgggtacccggtaacccgtacccggggtttaccccttaccccggtaacgtaacccgttaacgttccgtacgggttccggtacccgttaccggacggtacgtaacggaacggtacggtaacggtaccttagtacgtttacgttacgtacggtaccctagtacctacgtaacgttaacgtaaccggtacggtaccgtacgtaccgaacggttaccctacggtttacggttaaccggggtttaccggaccggaacgggtaacctacggccgttaccggacccgtacggtacggaaccgacgtacccgtaaggtcccgtcccggtcccgtcggtaacccg

SEQ ID NO: 150904 - DNA, 712 bp, Homo sapiens
  misc_feature: GYAE6OF01E4NJX.7.5.A05.1.454.CMB.1.raw
  modified_base (262)..(262): a, c, t, g, unknown or other
  misc_feature (262)..(262): n is a, c, g, or t
tcagcgtgtctctacacgaccggtgctcgatttagatagatagacgagggggggggtctcaggaggcagcgctctcgggacgtctccaccatggcctgggctctgctattcctcacccctcctcactcgagggcacgaggggtcgtgggcccagtctcgccctgactcagcctgcctcgtgtctgggtctcgtggacagtcgatccaccatcctcctgaccactacggaaccaccactggacgttgcttaggttaataaatnttcctctcctggtactacaacaactacccgagacctaaacgacccccaaagtcaatactactttatagtatgtactataacgtcggtacctttcggtacgggtttacctaatcgtacttcctgtccggtcctacgtaacgttcgtacgggaccgtaccgtacccgggtccctaccccgtacgacctacttccgtcgtacgggtcctaccgacggtactagggaacggtaacggcgggtactaacggttattaacgtttacgtcgtactacggtccttaatacgttaacgtacggacggtaccgacgtaccgaacgtccaccggttacgggttaaccgggtttcgggaccggggtaaccgggtaacgtcggtaccgtacgggtacccgttaccggtacggtaccgaccggtaacccggacggtcccgtccccggtcccggtcccgtacccg

SEQ ID NO: 150905 - DNA, 695 bp, Homo sapiens
  misc_feature: GYAE6OF01B2OK3.7.5.A05.1.454.CMB.1.raw
  modified_base (526)..(526): a, c, t, g, unknown or other
  misc_feature (526)..(526): n is a, c, g, or t
  modified_base (561)..(561): a, c, t, g, unknown or other
  misc_feature (561)..(561): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggctacgaggggtcggtcgggcccagtcgtcgccctagactcagcctgcctccgtgtctgggtctcctggacagtcgatcaccatctcctgctactcggaacccaccactcgtacgttgacgttaggttaaattaaactacttcctcttaccgtggttaactacaaactaactacccgaaggaacaaaccgaccccctaaatacactactaatttatagtatcgttactataacgtccggtctttcggtacgggtttacaacgttcgtccttcgtctcggtacctacgtaagttcgtcggacgtaccgacccggtccctacccgtacgtaccctacttccgtcgtacgggccttacggcgtcgtaagaacgtacgacgtactagtaacttacgttancgactacgctactattacgaacgacggacacgtanacgacgtagttaccgggttacgggttaccggaacgggtacggtaaccgacggttacgtaccggtaaccggttccggtaacgccggaaacccgtaccgggtacgtaccccggtcccgtccccgtacgggtacccc

SEQ ID NO: 150906 - DNA, 589 bp, Homo sapiens
  misc_feature: GYAE6OF01BOGXT.7.5.A05.1.454.CMB.1.raw
  modified_base (193)..(193): a, c, t, g, unknown or other
  misc_feature (193)..(193): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcaggcacagggtcgtgggcccagtctgccctgactcagccctgcctccgtgtctgggtctcctggacngtcgatcaccatctcctgcactggaaccacactgacgttgctggttataaatntctctcctggtatcaacataccaggacaacgaccccaagtcatacatttangtatgtactataactcgtccttcgacgggttccagtcgtcttctcgtgcctcaagtcgcgcgacacggccttccgnaccgtactcctcgtcgggctaccgaggctacggaacgacggagtctagtatttactacgtcgtacacgtactacaatacagtacgcacgtcacgtactacggttacgtaccgggtttcgggacggtacgggaaccctaaggtccgaggttaccccggtcgtaaccgggtaccgacggacccgtacggacccgtcccggtccccgtacggtaccccg

SEQ ID NO: 150907 - DNA, 716 bp, Homo sapiens
  misc_feature: GYAE6OF01EUH6G.7.5.A05.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctcgtgtctgggtctccgtggacngtcgactcaccatctcctgcactaggaacccaccactgacgttgctagttataaatntctctcctgtatcaacactaccagacaaacgacccccaagtcactacatttacngtatgtactaatacgtcgtccgttacgtacgggtttaccactcgtcttcctcgtcggtcctaccgtaacgttcgtaccgggaccgtaaccgcccgggtaccctccccgtacggtacctacgtcccgttacggtcgggccctaccggacgggtcgtacggtaaacggtaacggacggtccgttaacgttaatttaacgtaacgtcggactacgtacctacgtaattaacgtaacggacgacgacgaccgtacgtaccgtaacgtttccgggttaacggggttttccggggaccgggtaaaccgggtaaccgtacgggttaccgaccggttaaccccggttcggtaaccgtacccggaacccggtaacccgtaacgggttccccgtccccggtcccccggtacggttaccccg

SEQ ID NO: 150908 - DNA, 576 bp, Homo sapiens
  misc_feature: GYAE6OF01C8Z9S.7.5.A05.1.454.CMB.1.raw
  modified_base (335)..(335): a, c, t, g, unknown or other
  misc_feature (335)..(335): n is a, c, g, or t
  modified_base (440)..(440): a, c, t, g, unknown or other
  misc_feature (440)..(440): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctggtatcaacaatacccaggcaaagcccccaaagtcatcatttatgatgtctataatcgccttcgagggttccaatcgnttctctgctccaagtctggcgacacggcctccctcgaccatctcgtcgggtctccgaggctagaaggacgaggctgattattactgcagctcatatacaggcagnacgctaactcgtacgggttttcgggaccgggacgggtacccgaaggtccgttacggaccccggttccgttaacgggttaccgaacggtaccccggaaacgggccctcccggtcccccccgttcggggttaaccccc

SEQ ID NO: 150909 - DNA, 632 bp, Homo sapiens
  misc_feature: GYAE6OF01DDHYX.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatcctcctgcactacggaacccaccacgtgtacgttgcttaggttaataatntctctcctggtactacaacaactacccaggacaaacgtacccccaaagtctatactatttatgatgtactatagtcgcttcgtagggttcatcgtcttctctgtctccagtcgtgcgacgaccgcctccgtcgacctactctcgtcggtcctaccgagtcgtaggacgacgtagtactagtatttacttacgtcgacgatacgtactaagtactaaccgaggtacagacgtagacctacgttacggttacgggtttccggggacggaaccgggtaccgtacggtccggttaccggtacccggtttaccgtaccgggtacccgaaccggtacccggaaacgggtccctaccccgggtcccccggttccggttaccccgg

SEQ ID NO: 150910 - DNA, 663 bp, Homo sapiens
  misc_feature: GYAE6OF01A0BA9.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaatntctctcctgtatcaacaactaccaggacaaacgcccccaaagtcatactatttatgtatgtactaatacgtcgtccttcgtacgggttccaatcgcttctcgtcggtctacaagtcgtcggcgtaccgaccggccctcccgtacgacctactccgtcgtcgggtcctaccgacggtctacggaaacgacggtacggtcctaggtaactttacttaccgtacgtaccgacgtactacgtaacttaactaacgacgggtaccgaacgtccgtaacgtacccttaacggttaccggttacggggtttaccggggaccggtaaccggggaaccctaagggtccgtacggtacccggttaccgtacgggtaccaccggaccccgtacgggacccgtcccggtacccccgttcggtacccg

SEQ ID NO: 150911 - DNA, 682 bp, Homo sapiens
  misc_feature: GYAE6OF01B7OJP.7.5.A05.1.454.CMB.1.raw
  modified_base (319)..(319): a, c, t, g, unknown or other
  misc_feature (319)..(319): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctgccctgactcagcctgcctccgtgtctgggtctccgtggacagtcgatcaccatcctcctgcactacggaacccaccactgacgttgcttaggttaataatctctctccttggtataccaaacaactacccgaggaccaaacgacccccaaagtcatctatttangatgtactatagtccggtaccttcggtacgggtttccaagtcgtcttctcgtggtcctacgaagtcgtcggcgaccgccggtccctacccgtcgacctacgtccgttcggtcggcctaccggacggtacgtacggaacggaccgtaggtcgttagtaacgtttagttaccgtacgtacgtacgtactactaattaacgtaacgacggtacgacgtacgaccgtacttacgttacggtacggggtttccgggacggggtaacggtaaaccggacggtaccggtacggtaacccggttccggttaacggaccgacccggtacccggtaaccggcccgttccccggtccccggtccggttaccccg

SEQ ID NO: 150912 - DNA, 802 bp, Homo sapiens
  misc_feature: GYAE6OF01AX6QT.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgtacgttgcttgttataaatntctctcctgtatcaacaactaccaggacaaacgcccccaaagtcatactatttatgatgtactattaactccggtaccttcgtacggggtttaccaacgttcgtctttctcgtcggccttaccaaggttcgtacgggtacgaccgaaccggtccccttacccgtaccggtaaccctacgtttccgttaccggttcgggtacccttaccccgggtaacggtccgttaaacgggaaaccggtaaccgggaacgggtccgttaacggttacgttttaaacgtttacgtacggtaaccgaacggttaccctaccgtaaacgttaagtaacccgttaacgggtacccaacgggtacccgaaccggttaaccctaccggtttaaccgggtttaacccggggtttttaacccgggggaccgggtaaacggggtaaccccgggtaaacggtcccggttaacccgggtaaccccggttaccgggttaacggtcccgaaacccggtaacccggaacccggtacccggtcccccggttacccccggttccggttaccccccg

SEQ ID NO: 150913 - DNA, 569 bp, Homo sapiens
  misc_feature: GYAE6OF01AWNNH.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctctggtatcaacaatacccaggcaaacgcccccaaagtcatcatttatgatgtctataatcggcttcgtagggttccaatcgtcttctctgctcaagtctggcgacgcgcctccctcgaccactctcgtcgggcctccgaggctaggaacgacggaggctgtatttattacgtgcacgtctactactactacgagcaagcaggcctacgtacgtagggtttcgggcgggtaacggaaccgaacggtcgtacgtaccggttcccgtaacggtccgaaccggtcccgaacggtccgtcccggtcccccgttcggtaccc

SEQ ID NO: 150914 - DNA, 858 bp, Homo sapiens
  misc_feature: GYAE6OF01DM3R5.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcgaggcacgagggtcgtcgggcccagtctcgccctgactcacgtcctcgtcccgttcgtgtcgtcgggttctcgtaggacacgtcgtactccacctactcctctgacctacgaccggaacccacctacgtacgtacgttcgtacgttaagttaaataattctccttaccgttacgttaggtaaccaaacctaaacgtaaccgacccgaacggtaaacccaaccccggtaaccccctaaagttactaactttacttaagtttagtgtaacttacgtacttaacgttaccggtccgttaccgtttacggttaacggttacctacgtcgttaccttcgtcgttcgtacctacgtaacggtccgtacgaaccgtccgtaccgttccctaccgtacgacttaccgtcgtccgggtccggtactccggtacggtagtaaacggaacggtaccgtaggtacctttaagtaccgtttagtaccgtcgaacttccgaacgtaacttaaacgttcgaaccggaccgtaccgacgtaaccgttacctaacccggttacgggtttttacccggggttaaccggggttaaccggggaaccgggaaaacccggtaacggttttaaccgccccggtttaaaccgggtaaccccggtttggtaaccccgggaaacccggcccgggttaaaccccggtaccccggtacccccgtaccccccggttttcccggtaccgggtttaacccccc

SEQ ID NO: 150915 - DNA, 707 bp, Homo sapiens
  misc_feature: GYAE6OF01C88J6.7.5.A05.1.454.CMB.1.raw
  modified_base (515)..(515): a, c, t, g, unknown or other
  misc_feature (515)..(515): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgccctccgtgtcgtgggtcctcctggacagtcgactccaaccatcctcctgaccactaggaaacccaccactggacgttgcttaggttaataaatctctctcctgtatacaacaactaccgagacaaacgaccccaaagtcatctattatgattgtactatactcgtcttgacgggtttaccactcgtcttcgtcgtcgtctaccgagttcgtcggaccgaccgtaccggtcccttacccgtcggaacctacgttccgtccgttccgggaccctccggtacggtacgtaacggaacgggaccgtaggtccgtagttaacttagttacgtacggtactacgtccttaanacttaacgtacggtacggaccgaagtaccgaagtcccttaacgttcgggttacgggtttaccggggacgggtaaccgggtaaccgtaacggtcccgttacgggttaacccggtcccggttaacgggaccctaacccgggtacccgtaacgggtaccccgttaccccggtccccggtacccgggttacccccg

SEQ ID NO: 150916 - DNA, 751 bp, Homo sapiens
  misc_feature: GYAE6OF01CDFZI.7.5.A05.1.454.CMB.1.raw
  modified_base (252)..(252): a, c, t, g, unknown or other
  misc_feature (252)..(252): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcacgtggaaaccacactgacgttgcttaggttaataaaatntcttactccgtggtatacaaacaaactacccaaggaccaaaacggacccccaaatcctaatactaatttatagtatgttactaattaaagtccggtacctttacggtacggggttttaccaaagttccgtctttacgttcgtacggtacctacgtaaacgtcgttacggaccgtaaccgaacccgggtcccctacccgttacgaacccgacttaccgttcgtcggggtacctaccgacgggtacgtaacggaaacggaaccggaacggtaaccgttaggtaactttaaacgtttaacgttacgggactaacggtacttaacctaaattaacgttaacgaacgggactaacggacgacggtactaaccgttacggttaacggggtttttaccggggaacggggtaaccgggaaacggtaacggacgttacggtacccggttaacggtaacggtaccgaaccggacccgtaaacgccgtacccgtccccgtcggttacccg

SEQ ID NO: 150917 - DNA, 613 bp, Homo sapiens
  misc_feature: GYAE6OF01CBDC6.7.5.A05.1.454.CMB.1.raw
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgcttaggttaataatatctctcctggtatacaacaactacccaggacaaacgccccaagtcatcatttangatgtatatancgtcttcgagggtttccatcgtcttctctgctcagtcnggcgacncgcctcctcgacctatcctcgtcggcctaccgagctaggaacgacgacggtctagtattacttactgactagtctacgaatacgtaacgtagacgacgacgacgaccgtacgttacggttacggggttttaccgggacgggtaacgggaacccgtaacggtccgtaccggtaacccggttccgtaaccgggtaccgtaccggaaccccggtacgggtaccccttccccggtcccccgttcgggttaccccg

SEQ ID NO: 150918 - DNA, 857 bp, Homo sapiens
  misc_feature: GYAE6OF01C8Z19.7.5.A05.1.454.CMB.1.raw
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatcctcctgcacctggaacccaccacgtgacgttgcttaggttaataatntctctctaggtatacaacaactacccaggaccaaacgccccaaagtccatactaattttangtagttgtactaagttaacgtccggtcctttcggtaacgggtttccaaacgttccgtactttcgttccgttacggtccgttacccgaaaggttccgtacgggtaccgaaccgtaacccgggtccccttacccgttacggtaacccttacgttccgttacggttacgggtcccttaccccgggtaacgggtaccgtaaacggggtaaaacccgggtaccggaacgggttaccgttaacggtttaacgttttaacgtttacccgttacggtaccgttaacggtaccctttaaccgtaacgttaaacgtaaccggtaacgggtacccgaaacgttaccgaaccggttaccgttaacccggttacgggtttaacgggggttttacccggggaacgggggtaaacccggggtaacccgtaaaccggggtccggttaacccggttaaccccgggttcccgggttaaaccgggttaaccgaccccgggttaaaccccggacgggttaccccgttacccccgggtcccccccggtttacggttaccccccgg

SEQ ID NO: 150919 - DNA, 638 bp, Homo sapiens
  misc_feature: GYAE6OF01CJ5GT.7.5.A05.1.454.CMB.1.raw
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
tcagcgtgtctctacacgaccggtgctcgatttagatagatagacgaggggggggtctcaaggaggcagcgctctcgggacgtctccacatggctggctctgctattcctcaccctcctcactcagggcacagggtcgtggcccagtctgccctgactcagcctgcctccgtgtcgtgggtctccgtggacagtcgaatcaccatcctcctgctactcggaaaccaccactagacgttgacgttggttaaanaagttactctctctagtactacaaacaactacccagacaaaccgcccctaaagtcatctatttangtatcgtactaatatcgtcttcggacgggttcagtcgtcttcgtcgtcgtctacctaagtcgtggaccaccgaccggtccctaccgtacgacctacgttcgtacgtcggtcctcggtacggtcgttaaggacgtacgtacggattacgtaactttagttaaccgtcgtacctagtcctactacgttacgaacgtacggacacgtcgtaacgtacctacggtaccgttacgggttccggacgggaccggtacgacggtccgtacgtacggttccgtacgtcgtacccgacgtaacggtcccgcccgtcccgtacggtacccg

SEQ ID NO: 150920 - DNA, 619 bp, Homo sapiens
  misc_feature: GYAE6OF01DH075.7.5.A05.1.454.CMB.1.raw
  modified_base (196)..(196): a, c, t, g, unknown or other
  misc_feature (196)..(196): n is a, c, g, or t
  modified_base (322)..(322): a, c, t, g, unknown or other
  misc_feature (322)..(322): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtggcccagtctcgccctgactcagcctgcctccgtgtcgtgggtctccgtggacngtcgatcacatcctcctgcactacggaaccacactgacgttgctagttaataatatctctccgtagtactacaaacaactaccgaagaccaaaaccgaccccgtaaatctaactactaagtttaangtattgtactaagttaactccggtctttacgtacggtttaccacgttcgtcttctcgtgctacagtcgtacgaccgactccgcctccacgactcgtcgtcgtacggctacgtcggacgtaggaacggacgtacggtacttgttaactttacgtacgtcgataccggtcttactaagttacgaacgtacgacacgtacgacgttacctacggttcgttacgggtcggtacggacgacctagtccgtacgtacccgtgttaccgcaccggtaccacgtcccgtccacccggtgtacccg

SEQ ID NO: 150921 - DNA, 606 bp, Homo sapiens
  misc_feature: GYAE6OF01DYGM8.7.5.A05.1.454.CMB.1.raw
  modified_base (139)..(139): a, c, t, g, unknown or other
  misc_feature (139)..(139): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (430)..(430): a, c, t, g, unknown or other
  misc_feature (430)..(430): n is a, c, g, or t
tcagcgtgtctctacacgaccggtgctcgatttagatagatagacaggggggggtctcaggaggcagcgcttctcgggacgtctccaccgagtggcctgggctctgcttattcctcacccttcctcactcagggcacgngggtcgtgggcccagtctgccctgactcagcctgcctcgtgtctggtctctggacngtcgatcacntctcctgcactggaaccacactgacgttgctggttaataatntctctcctgtatcaacaatacccaggacaaacgccccaagtcatctatttatgatgtactataatcggtcttcgtagggtttccaatcgcttctcgtggctcaagtcgtggcacgacgcctcctcgacctatctcgtcggcctccgaggtctaggaacgcggaggtctagtatttacttacgncgacgtctacgaattactaacgaggacaggaccagtactaccgttacggttacggggtttccgggacgggtaccgggtaaccgtacgggtccgttacgggtaccccggtttcgtaacgggtaccgtaaccggacccgtaacgggcccttacccgggccccccgttggttaaccccg

SEQ ID NO: 150922 - DNA, 614 bp, Homo sapiens
  misc_feature: GYAE6OF01CRKUO.7.5.A05.1.454.CMB.1.raw
  modified_base (305)..(305): a, c, t, g, unknown or other
  misc_feature (305)..(305): n is a, c, g, or t
tcagcgtgtctctacacgaccggtgctcgatttagatagatagacgaggggggggtctcaggaggcagcgctcgtcgggacgtctccaccatggcctgggctctgctattcctcaccctcctcactcagggcacgagggtcgtgggcccagtctgcctgactcagcctgcctccgtgtctgggtctccgtggacagtcgatcacatctcctgcactcggaaccacacgtagcgttgcttaggtaataatactctactcgtgtatacaaacaactaccagacaaacgccccaagtcatctatttancgatgtctaatactcgtacttgacgggttactagtctcttcgtctcggctaccgagttcgagcgacaccggtcccacgtcgactactcttcgtggtacctcgacggtacgtacggaagaccgggtagaccgtttaggtaaactttttacgtacgtacgacttaggacttacggaatttacgaacgaggccaagaccactactaacggtcgttaacgggttcggcggtaacggaaccaggccgttacgacgtaccggttcgtaaccgacggtaccccgaggttacccggcccgtccccgtcggttacccg

SEQ ID NO: 150923 - DNA, 614 bp, Homo sapiens
  misc_feature: GYAE6OF01D6120.7.5.A05.1.454.CMB.1.raw
  modified_base (382)..(382): a, c, t, g, unknown or other
  misc_feature (382)..(382): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (470)..(470): a, c, t, g, unknown or other
  misc_feature (470)..(470): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcacagggtcggtgggcccagtctgccctgactcagcctgcctccgtgtctgggtctccgtggacagtcgatccaccatcctcctcgcactcggaacccaccactgacgttgcttaggttataaatatctctcctgtactacaacaactaccagacaaacgaccccaaagtccatctatttatgtatgtctaatagtccgtacttcgtacgggtttaccaatcgtcttctcgtcgtctcgagtcgtgcgaccncgcctcccgtgacctatcctcgtcggctccgaggctagaaacggcgagtctagtattattacgngacctntctactatacgaagacgnacgtaccagtacctacgttcggttaacggggtttaccgggacgggtaaccgggaaccgtaacggtcccgtaggtaccccggttccggtaccggtaccaccggtacccgacgtccccgtccccggtccccgttcccggtaccccg

SEQ ID NO: 150924 - DNA, 683 bp, Homo sapiens
  misc_feature: GYAE6OF01BRJMH.7.5.A05.1.454.CMB.1.raw
  modified_base (344)..(344): a, c, t, g, unknown or other
  misc_feature (344)..(344): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgccttccgtgtctgggtctcctggacagtcgatcaccatctctgcactggaaccaccagtgaccgttgcttggttaataaagtctcttctctggtatacaacaactacccaggacaaaacgaccccaaagtcatcatttactgatgtctaataatcgcgttctagggtttcaatccgtnttacctctcggctcgaacgtcgtgcgtacacggtcctccgtacgaccattacgtcgtagggtccttaccgacgggtacttacgggaaacggaaccggacgggtacgttacggtaacttttacgtttaacgttcggacgtaccggtactacgtaacgttaacgtaaccgtaaggacctaaccgggacgtaacgtacccgtaaccgttacgggttaccggttttacggggaccgggtaacggggaaacccgtaacggtccgtaaccggtaccggtacggttacggaaccgtacggtaccccggaacgggtacccttccggtacccccgttacggtaccccg

SEQ ID NO: 150925 - DNA, 634 bp, Homo sapiens
  misc_feature: GYAE6OF01A316U.7.5.A05.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacgaggggggggtcgtcaggaggcagcgctctcgggacgtctccaccatggcctgggctcgtgctattcctcaccctcctcactcaggcacagggtcgtgggcccagtctgccctgacctcagcctgcctccgtgtctgggtcctccgtggacngtcgatcacctatcnctgcactgaaccaccatcgcgttgctaggttaataaagtntctctctagtactacaacaactaccgagacaaccgacccgtaatcatctattagtgtatctactatacgtcgtacttacgtacggtactagtctctcgtcgtcgtcgtacgtacgtcgtacggacgtaccgtaccgtcccgtccgtactacctacgtccgtcgtcgtacctcgtacgtacgtaacggtaacggtacgtacggtactagtacgttacttacgtacgtacgtacgtacgtactaactacgtaacgacgacgacgtactacgtactacgtacgttacggttacggacggtacggaccgtacgtcgtaccggtaccgtaccggtacgtacccgtaccggtaaccgtaccggtacccgtcccgtcccgtccgtaccc

SEQ ID NO: 150926 - DNA, 613 bp, Homo sapiens
  misc_feature: GYAE6OF01AQU1M.7.5.A05.1.454.CMB.1.raw
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaacccaccactgacgttgcttaggttaataaatntctctcctgtatacaacaactacccagacaaacgcccccaaagtcatcatttangatgtactataacgtccgtcttacgtacgggtttaccactcgtcttctctcggctacgagtcgngcgacgaccgcctccctcgaccatcctcgtcggtcctacgaggtctaggaagacggacgtctagtactttactacgtcgacacgtcctactaattactacgacggtacgacgtacacgtcctaacgttcggttacgggtttccgggacgggtacggtaaccgaacggtccgtaccggtaccggtccgtacggtccgaaccggacccgaccggtcccgtaccccgtccccggttcggtaccccg

SEQ ID NO: 150927 - DNA, 825 bp, Homo sapiens
  misc_feature: GYAE6OF01ANLIY.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctgtatcaacaataccagacaaacgccccaaagtcatctatttatgatgtactataatccggtccttcgtacggggtttaccaacttcgtcctttccttccgttcgggtaccttacccgtaacgttccgtacgggtacccggaaccgtacccggtcccccttccccgttaccggtaacccctaacttcccgttccggttcggggtcccttacccggaacgggtccgttaagggaaacggaaccgggaacgggtccgtaggttaacttttaacgtttacgtcgtacgtacgtcccttactaacgttaacgtaacccggtaacgggtaccgaacgggacccgtaaccggtaccgttaacccgtttaccgggtttaaccggggtttttacccggggggacccggggttaaaccgggggaaaccccgtaaacggggtcccgtttaacccggggaacccccggtttacccggttaaacccgggggtacccgtaaaccccggggtaacccccggtaaaccggggttcccccggttacccccgggttcccccccccggttcccggggtttaaccccccgg

SEQ ID NO: 150928 - DNA, 599 bp, Homo sapiens
  misc_feature: GYAE6OF01CTDSR.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcaccatctcctgcactggaaccaccactgacgtttgcttaggttaataaattatctctcctggtactacaaacaactaccaggacaaacgaccccaaagtcatctaatttatcgatgtactataatcggtcttcgtagggtttccaagttcgtcttctctcggtctcgtaacgtcgtcggaccgacgtaccgggccctaccgtcgacctactcgtcgtcgggcctccgacggctaggaagacggacgtctagtacttattactgcagtctacgtatactacgaggacaggcagctacgtcggtaggtttcgggacgggtacggaccgacgtccgtcggtaccgtccgtacggtaccgaccggtaccgacggtacccgtcccggtccccgtcggtacccg

SEQ ID NO: 150929 - DNA, 575 bp, Homo sapiens
  misc_feature: GYAE6OF01APIMZ.7.5.A05.1.454.CMB.1.raw
  modified_base (249)..(249): a, c, t, g, unknown or other
  misc_feature (249)..(249): n is a, c, g, or t
  modified_base (487)..(487): a, c, t, g, unknown or other
  misc_feature (487)..(487): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttaggttataaatntctctcctgtatcaacaatacccagacaaacgaccccaaagtcatctatttatgattgtactataactcggtccttcgtacgggtttccaatcgcttctctggctcgtaagtcgtggcgacacggcctcctcgacctatccgtcgtcggtcctcgacggtctacggaacgtacgtacggtacttagtaactttacttacgtgactacgtctataacgttacgtacgacggacacgacncgctacgtacgtacggttcggacggtacggacgagtcgtacgtaccgtcgtacgaccgacgaccgacgtaccgtcccgccgtcgtacc

SEQ ID NO: 150930 - DNA, 744 bp, Homo sapiens
  misc_feature: GYAE6OF01C0Z3T.7.5.A05.1.454.CMB.1.raw
tcagcgtgtctctacacgaccggtgctcgatttagatagatagacgaggggggggtctcaggaggcagcgctctcgggacgtctccaccatggcctggctctgctattcctcaccctcctcactcagggcacagggtcgtggcccagtctgccctgactcagcctgcctccgtgtctgggtctctggacagtcgatcaccatctcctgcactcggaaccaccactgacgttgacgtaggttaaataaatactctacttccgtaggttatacaaacctaactaacccgaaggaccaaaaccgacccccaaaagtccaatactaagttttatagtattgttacctaattaacgtccggtccgttttacggacgggttttaccaaacgttcgtcgtttcctacgttccggtactaccgtaaggtcgtacggacccgaaccgacccggtccttaccctacgaacctactccgttcgtcgggtcctccgaacgtcgtaggaacgtacggagtactagtactttactaacgtcacgacgtctacgtaattacgaaacgacgggacaagggacctacggtacctaaccgtttacgggttaacggggttttaaccgggaaccggggaacgggtaaccccgtaaagggtcccgttaaccgggttacccgttacccggttaacgggtacccgtaaaccgggtaacccccgaacggtccccgttaacccggtcccccccgggttcggttaacccc

SEQ ID NO: 150931 - DNA, 686 bp, Homo sapiens
  misc_feature: GYAE6OF01C0GZ3.7.5.A05.1.454.CMB.1.raw
  modified_base (342)..(342): a, c, t, g, unknown or other
  misc_feature (342)..(342): n is a, c, g, or t
  modified_base (572)..(572): a, c, t, g, unknown or other
  misc_feature (572)..(572): n is a, c, g, or t
tcagcgtgtctctacacgaccggtgctcgatttagatagatagacgaggggggggtctcaggaggcagcgctcgtcgggacgtctccaccatggcctgggctctgctattcctcaccctcctcactcagggcacgagggtcgtgggcccagtctcgccctgactcagcctgcctccgtgtcgtgggtcctccgtggacagtcgatccaccatcctcctgaccacgtacggaaacccactacgtggtacgttgtcttaggttaaataaacttctctacttcgtagtactacaaactaactaccgaagacctaaacgacccctaaagtcaacttactatttacngtatcgtactaatacgtccggtcttacgtacgggttacaactcgtcttctcgtcgtaccttacgacgttcgtacggaccgaaccgtcccggtccctcccgtacggaccttcgtccgttcggtcggtccctacggacggtacgtaacgggaaacggcggtacgtactaggtttaacttacttacgtcgacgtacgtctaactacgtaacgtaccgaacggtacacggtacnccgtacgtacgtcggttaacggttcgggacggaacggtaccacgtcgtccggtacggtcgtacggtaccaccgtacccggtacggtcccgtacccggtcccccgtggttccccg

SEQ ID NO: 150932 - DNA, 630 bp, Homo sapiens
  misc_feature: GYAE6OF01CRFDT.7.5.A05.1.454.CMB.1.raw
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
  modified_base (462)..(462): a, c, t, g, unknown or other
  misc_feature (462)..(462): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcacatctcctgcactggaaccaccatgacgttgcttggtaataaatntctctcctaggtactacaaactaactacccaggaccaaaacgcccccaaagtcattctaatttangattgtactaataactcggtactttcgtagggtttccaatccgtcttctactggactcaagtctggacgacaccggtcctccgtagacctatcgtcgtaggccctacggacgacgtacgaacggacggtagtccgttagtaacgttattaacgngtacagtactactacgttacgtaaccgagggaccacggtcacgcctacgttacggtagggttttccggaccggggaacggtacgaacgtaccgtcggtaacccggttaccggtacgttacccgacggtacccgaacggtcccgtacccgtcccccggttcgtaacccg

SEQ ID NO: 150933 - DNA, 699 bp, Homo sapiens
  misc_feature: GYAE6OF01BJYLR.7.5.A05.1.454.CMB.1.raw
  modified_base (301)..(301): a, c, t, g, unknown or other
  misc_feature (301)..(301): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctctgcactggaaccacactgacgttgctggttaataaatctctctctgtactcaacaactaccaggacaaacgccccaaagtcatactatttangatgtctataactcgtccttcgtagggtttaccaagttccgtcttctcgtcggtcctaccgtaacgttccgtacggaccgaccgtaaccggtcccgtacccgtagaccctacgttcctcgtccgggtcccttaccggacggtaccgttaacggaacggaacggtacggtactacggttactttaacgtttacgtacgtaccgtacgtactacgtactaacgtaacgacggacgtacgaccgacgtactaccgttacggttacgggttttaccgggacgggtaaccgggtaaaccctagggtaccgttaccgggtaccggttacccgtaacgggttacccgaaccggtaccccgtaacgggtccccgttaccccggtcccccggttccgggttaacccc

SEQ ID NO: 150934 - DNA, 569 bp, Homo sapiens
  misc_feature: GYAE6OF01AW854.7.5.A05.1.454.CMB.1.raw
  modified_base (451)..(451): a, c, t, g, unknown or other
  misc_feature (451)..(451): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttgctaggttaataaatatctctctggtatacaacactacccagacaaacgcccccaaagtcatctatttatgatgtctaataatcggtccttgtacgggtttcaatcgtcttctcgtgctaccagtcgtcggcgacgccgtccctccctgacctatcctcgtcggctaccgagggtctagggaacgacggaggctacgatttattacgtgactagctnaactatacgagcagcagctactcgtagggttccgggacggacgggaccgagccgtcgtaaccggtcctacggtaccgaacgtacccggaacgtcccgttcccgcccgtccgtaccccg

SEQ ID NO: 150935 - DNA, 724 bp, Homo sapiens
  misc_feature: GYAE6OF01C85TR.7.5.A05.1.454.CMB.1.raw
  modified_base (339)..(339): a, c, t, g, unknown or other
  misc_feature (339)..(339): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgccacgtcggaaacccacctacgtacgtacgtttgtccgttaggtttaataaattactctccttcctaggtactacaaacaactacccgaaggaccaaaccgacccccaaagtcctatactatttangtatgtactaatacgtccggtcctttcgtacgggtttaccagtcgtctcttcgtacgtcctacgtaacgtcgtcggaccgacgtcccgtcctcccgtacgtaccctaactccgttcgtccgggtcctccggacggtactacggaaacggtacggtacgtacgttagtaactttacgtaccgtcgtaccgtacgtaccgttactaagttaacgtaaccgcggtaccgaaccggtcaaccgtccttaacggttccggttaacggggttcccgggaacgggtaccgggaaaccgtaggtaccggtaccgtacccggttaccggtacggtacccgtaaccggaccccggtaggtacccggttcccccgtccccggttacggttaccccg

SEQ ID NO: 150936 - DNA, 551 bp, Homo sapiens
  misc_feature: GYAE6OF01C1EFA.7.5.A05.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagcgtgtctctacacgaccggtgctcgatttagatagatagacaggggggggtctcaggaggcagcgctctcgggacgtctccgaccatggcctgggctctgctattccgtcaccctcctcactcagggcacagggtcgtgggcccagtctgccctgactcagcctgcctccgtgtctgggtctcctggacagtcgatcaccatctcctgcactggaaccnccactgacgttgctggttataaatntctctcctggtatcaacaatacccaggacaaagccccaaagtcatcatttatgatgtctataatcgccttcgagggtttccaatcgcttctctcggctcaagtctggcgacacgcctccctgaccactctctgggcctccgaggctgaagacgaggctgtattattactgcagtctacatatacgagcagcacgctacgtacgttacgggtttcggacgggtacgggaccgaagtccggtagacccggttccgaacggttacaccggcccgaaacggccgtacccgccccgtcggttaccccg

SEQ ID NO: 150937 - DNA, 590 bp, Homo sapiens
  misc_feature: GYAE6OF01AWQCD.7.5.A05.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttataaatntctctcctgtactacaacaactacccagacaaacgccccaaagtcatctatttangtatgtctaatacgtcgtccttcgtagggttccaatcgtcttctctcggtctacaacgtcgtcggcgaccgaccggtccctccctcgaccctactctcgtcggcctccgaggtctaggaacgacgaggtctagtattacttactgacagtctacatacgtacgacgtcagcacgactacgtcgtacgggtttccgggacgggtaacgggaaccgtaacggcgtacggacccgttcgtaacggtaccgaccgacccggtacggccgtcccggtccccgtcggtacccg

SEQ ID NO: 150938 - DNA, 581 bp, Homo sapiens
  misc_feature: GYAE6OF01EB2M3.7.5.A05.1.454.CMB.1.raw
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttgctggttaataaatntctctctggtatcaacatacccaggcaaagcccccaaagtcatcatttatgatgtctaataatcggtccttcgagggtttccaatctcttctctggctccaagtcnggcgacacgccctccctgaccatctcgtcggtctccaggctggaaagacggaggntagtatttattacgtgcagtactnaatactanaggcagcagctactcgttagggtttcgggacgggtacggggaaccctaacggccgtacggtaccccggtccggttaacggtcccgaacggtaccccggaacgggacccgttcccggtccccccggtacggttaccccg

SEQ ID NO: 150939 - DNA, 723 bp, Homo sapiens
  misc_feature: GYAE6OF01D8BB6.7.5.A05.1.454.CMB.1.raw
  modified_base (528)..(528): a, c, t, g, unknown or other
  misc_feature (528)..(528): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctcgtgtcgtgggtctcctggacagtcgatcaccatcctctgcacgtcggaacccaccactgtacgttgcttaggttaataaatctctctctgtactacaacaactaccagacaaaccgacccaagtctatctaattatgtatgtactaagtacgtccggtcctttacggtaacgggtttcctaacgtcgttccttcgttcgtcggtaccttacctaacggttcgtacggtaccgacccgtacccggtcccctccctacgaaccctacgtccgttccggtcgggtcctacccggtacgggtaccgtaacggaaacgggaccggtaacggtcgttaacgttaactttaacgtttaccgngtaccgtacgtccttaagtaacttaacgaacgacggacgaacgtccgtaacgtaccgtacgttacgggttaacgggttccggggaacgggtaccgggaacctacggtaccgttaccgggtacccgttacggtacggtacccgaacccggtacccgtaaccgggtccccgttccccggtcccccgttcggtacccc

SEQ ID NO: 150940 - DNA, 545 bp, Homo sapiens
  misc_feature: GYAE6OF01CG9HM.7.5.A05.1.454.CMB.1.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (441)..(441): a, c, t, g, unknown or other
  misc_feature (441)..(441): n is a, c, g, or t
  modified_base (509)..(509): a, c, t, g, unknown or other
  misc_feature (509)..(509): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacatgacgttgctggttaataaatatctctctgtancaacaataccagacaaacgccccaaagtcatctaatttangtatgtactataacgtcgtcctcgtagggttccaatcgtcttctctgtcctcgaagtcgtaggcgacaccggccctaccgtgaacccattccgtcgtcggcctccgagtcgtagaagcgagtctagtattatactgacagctanataatcgagtcagcatcacgtatacgggttcgacggacggaacaggtcctagtacccggtcgtacggngaccgaccgaacgtccgcccgtccccgtcggtaccc

SEQ ID NO: 150941 - DNA, 808 bp, Homo sapiens
  misc_feature: GYAE6OF01DSZ0Q.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcgagggcacgaggggtcgtcgggcccagtctcgccctgactcagcctgcctcgtgtcgtcgggtctccgtggacagtcgatcacctatcctcctgacacgtacggaacccacctacgtcgtacggttgtcgttaaggtttaaataaattacttccttctaccgtaggtactacaaacgaaacctacccgaacggaacctaaaaccgaccccctaaaaggtactaatacttaatttagtagtaagttagttacttaaacgttaacgttccggttaccgtttacgggttaacgggttttaccacgttaccgtctttcctacgttcggtacctaccgtaacgttcggtacggaccggaccgtaccgtccctacccgtacgacccgttacttccgtccgtcgggtcctaccggacgggtactacgggaaacggacgggtacgtacgtaagttaactttacgttacgtcgacgtaccttactacgtaactacgtaaccggaacgcgaaccggtcaaccgtaccgttaacgttaccggttaccggggtttacgggaaccgggtaaccggggaacgtaccgggtaccggtaacccggttacccggttaacccgggttccgggtaaccccgaacccgggtaccccggtaacggttccccggtaccccggtcccggttcgttacccccggg

SEQ ID NO: 150942 - DNA, 651 bp, Homo sapiens
  misc_feature: GYAE6OF01EO7FF.7.5.A05.1.454.CMB.1.raw
  modified_base (311)..(311): a, c, t, g, unknown or other
  misc_feature (311)..(311): n is a, c, g, or t
  modified_base (480)..(480): a, c, t, g, unknown or other
  misc_feature (480)..(480): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcaaccatcctctgcactcggaaccaccactgacgttgctaggttaataaatatctctctggtactacaaacaataccaggacaaacgaccccaaagtcatactatttacngtactgtactaataacgtcgtccgttacgtaacgggttacctaatcgtcttcgtctaggtctactaacgtcgtcgacgacgtacgtcccgtcctacgacctactactcgtacggccttcgacggtacgtaaggaacgaacggtacgtcgtaatattactagtcgacganacttacgaataactaacggtacgactacgggacaccggtacttaacccgtcgggttaacgggtttccggggaccgggaacggggtaaacgtacgtacgtacgggtacccgtttaccggacggtaccaccgggtaacccgaacggttccgacccgtcccccgtaggttaccc

SEQ ID NO: 150943 - DNA, 618 bp, Homo sapiens
  misc_feature: GYAE6OF01BX85M.7.5.A05.1.454.CMB.1.raw
  modified_base (524)..(524): a, c, t, g, unknown or other
  misc_feature (524)..(524): n is a, c, g, or t
  modified_base (560)..(560): a, c, t, g, unknown or other
  misc_feature (560)..(560): n is a, c, g, or t
  modified_base (601)..(601): a, c, t, g, unknown or other
  misc_feature (601)..(601): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgccctccgtgtctgggtctccgtggacagtcgatcaccatctcctgcacgtcggaaccacactgacgttgatggttaataaatatctctcctagtactacaacaactaccgagacaaaccgaccccaaagtcactactattatagattgtactaataactccggtaccgttacgtacgggtttacctaacgtccgtctttccgtcgtcgtacctacgtaacgtcgtcggaccgaccgtaccggtccctacccgtacgtaaccctacgttccgtcgtcgggccgttacgacggtacgtagacgtacggaggtacctagtacttacgtacgtgacagtctatactagtacgagtacganacgactctacgtcggtacggttcgggacgacggtanacgtcgtacgaccgtcgacggtaccaccggtacgcgtaccncccgtcccgtgtacccg

SEQ ID NO: 150944 - DNA, 627 bp, Homo sapiens
  misc_feature: GYAE6OF01D1NHW.7.5.A05.1.454.CMB.1.raw
  modified_base (477)..(477): a, c, t, g, unknown or other
  misc_feature (477)..(477): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcacatcctctgcactcggaaccaccactgtaccgttgcttaggtttaataaatctctctccgtggtactacaacaactacccgaggacaaacgaccccaaagtcatctatttatgtatgtctataacgtcgtccttcgtaggtttaccagtcgtcttctctcggctacgtagtcgtcggcaccgacgtccctcctgaaccctagtcctcgtcggtctccgaaggtcgtagaacgacgagtctagtatttagtactgacagtctactaatactaacgnggtacagtacagtacctaaccgttacggttacgggtttaccgggacgggtacggaaacccgtacgggtccgttaaccggacccggttaccgtaaggttacccgaacgggacccgtaacggtacccttcccggtcccccgttacggtaccc

SEQ ID NO: 150945 - DNA, 593 bp, Homo sapiens
  misc_feature: GYAE6OF01ESUVN.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatacaacaactaccaggacaaacgcccccaaagtcatctatttatgtatgtactataagtcggtcttcgtagggttccaatcgtcttctctgctcagtctggcgacacggtccctcctcgacctatctcgtcgggctccgaggcgtagaacggtacgaggtactgtaatttagttactgaccgtagtctacaattactacgacgggacacgtacaacgctacgttcggtacggggttttcgggaccgggtaacggaccgaaggtccgtaggacccggttcgtaacggtcgaccggtacccgaacgggtccctcccggccccgttccgggtaccc

SEQ ID NO: 150946 - DNA, 586 bp, Homo sapiens
  misc_feature: GYAE6OF01EK7CU.7.5.A05.1.454.CMB.1.raw
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatccaccatcctcctgcacgtcggaaccaccactgaccgtttgcttaggttaataaatctcctctcctggtatcaacaactacccaggacaaacgacccccaaagtcatcaatttatgatgtctataagtcgtccttgtacgggttaccaatcgtcttactctcggtctacgaagtcgtggcaccgacggccctcctcgacctntctcgtcggctaccgngctagacgacgaggctatattacttacncgacncgctanatancgtagacacgacagtcacgttacgtacgggtttacggacgggacggaacctagggtcttacggtacccgttcggacggttcgacccggtaccgacggtcccgtccgtccccgtacggtaccccg

SEQ ID NO: 150947 - DNA, 866 bp, Homo sapiens
  misc_feature: GYAE6OF01CXR9H.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctcgtgtctgggtctcctggacagtcgatcaccatcctcctgacactggaaacccaccactgacgttgacttagggtttaaataaacttactcgttccttcccgttagggttaactacctaaaaccaaacgttaaccccgaaaggggaaccctaaaaccggaccccccctaaaaaggtcccaacttaccgttaattttaactacggtaattacggttaccttaagttaaacttccgggtaccctttacggtaacgggggtttttacccaaacgtttccggtccgttttacctcgtttacggtaacccgttaccgtaaacggttccggtacggggtacccgtaaccgtaccccgggtaccctttaccccgtccggtaacctaacgttccgttcggtaccgggtaccctaccggtacggggtactacggggaaacggtacccgggtaaggtacgtaaggtttaactttacgttaacccgttcggacggtacttaccttaccgaatttaacgtaccgaacgggtaccgacggtaccgtacggacccgttaagttacccggtttaacggggtttacccgggacgggtaaaccgggtacccgtaaaggtcccgttaacgggtaccccgttacggttaccgggtaacccgaccgggtacccgtaaaccgggtccttaccccggtacccccggttcgtaacccccg

SEQ ID NO: 150948 - DNA, 651 bp, Homo sapiens
  misc_feature: GYAE6OF01AV394.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatntctctctgtatcaacaataccaggcaaacgccccaaagtcatcatttatgatgtactataactcgccttcgagggtttccaatcgcttctctggctcaagtctggcgacacggccctcctgaccatctacgtcgggtcctccgaggtctacggaaacgacggacggcttagtaactttacgtttaacgtcggtactacggtcttacgaattaactacgaaggccaacggtccgtaacgacctacgttaccggttaacggggttttccggggacgggtaacggggaaccctaacgggtacccgttaccgggtaaccccggttcccgttaacgggtacccgaacccgggtaccccgtaaacgggtcccccgtttacccgggtcccccccggttcgggtttaacccccg

SEQ ID NO: 150949 - DNA, 720 bp, Homo sapiens
  misc_feature: GYAE6OF01CD2UT.7.5.A05.1.454.CMB.1.raw
  modified_base (209)..(209): a, c, t, g, unknown or other
  misc_feature (209)..(209): n is a, c, g, or t
  modified_base (683)..(683): a, c, t, g, unknown or other
  misc_feature (683)..(683): n is a, c, g, or t
  modified_base (695)..(695): a, c, t, g, unknown or other
  misc_feature (695)..(695): n is a, c, g, or t
tcagcgtgtctctacacgaccggtgctcgatttagatagatagacgaggggggggtctcaggaggcagcgctcgtcgggacgtctccaccatggcctgggctctgctattcctcaccctcctcactcgagggcacgagggtcgtggcccagtctcgccctgactcacgcctgcctcgtgtcgtcggtctccgtggacagtcgatcaccntctcctgcacgtacgaacccacacgtgacgttcgcgtagttaataatctctctcgtagtactacaaactaactaccgaacgacaaaccgacccctaaagtctactactactttatcgtacgttcgtacgttaatacgtccggttaccgtttacggtaacgggtttaccaacgttccgtacttcgtcgtcgtactaccgtaacgtcggtcgaccgtacccgtaccgggtcccttaccgacgtaaccctacgttccggttacggtaccggtcccgtaccgaggtaccggtaaacgggaaacggtaccggtaacggtacttaacggttaactttaacgttcgacgtcacgtactacgtaatacgtacgacgacacgggtactaggtacctacgttacgggtacgggttacgggaccggtaaccggaacacggtaccgtaccggtaccggttcgaaccgggtacgcccgggttaaccnccgggttacccncccgggttccccgtacggtaccccg

SEQ ID NO: 150950 - DNA, 558 bp, Homo sapiens
  misc_feature: GYAE6OF01BWYEB.7.5.A05.1.454.CMB.1.raw
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccagacaaacgcccccaaagtcatcatttatgatgtctataatcgccttcgagggtttcaatcgcttctctggctcaagtctggcacacgcctccctnaccatctctggctccgagtctagagacgaggctgtattattactgacanctacatatacgagcagcacgcacgtcgtagggtttcgggacgggtacggaaccgaacggtcgttacggacccggttcccgtaacgggttacccaaccggtacccgaacggtaccccgtccggccccccgttcggtaacccccg

SEQ ID NO: 150951 - DNA, 582 bp, Homo sapiens
  misc_feature: GYAE6OF01BZAQU.7.5.A05.1.454.CMB.1.raw
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttgcttaggttaataaatatcctctctggtatcaacaatacccagacaaacgcccccaaagtcatcatttatgatgtctataatcgccttgtagggttccaatcgcttctctgctcagtcnggcacncggcctcctgaccntctcgtcgggctccgaggctagacggacgacggtctaggtactttattacgtcgctacgcgtactaataactacgaacggcaaggcaagtccaacgttccgtacgggttttccgggacgggacggaacccgaggtccgttacggtacccgtacggtacggtaccgacgcccggtaaacggtccgtcccggccccgttcgggtaccccg

SEQ ID NO: 150952 - DNA, 715 bp, Homo sapiens
  misc_feature: GYAE6OF01D3T7V.7.5.A05.1.454.CMB.1.raw
  modified_base (250)..(250): a, c, t, g, unknown or other
  misc_feature (250)..(250): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgcttggttaataaatntctctcctggtatacaacaatacccagacaaacgccccaaagtcatcatttatgatgtactataatcggtcttgtacgggttcaagtcgtcttctctcggtctaccaagtcgtaggacgaccgaccggtccctcccgtacgtacctattccgtcgtcgggccgtacccgagggtcgtaacggaacggtacggaacggtacgttagtacgtttagtttaccgtgacctacgtaccttactaattaacgtaacgtaacgggaccgtaagaccgtaacgtaccttaccggttaccgggtttacgggggttttacccgggaaccgggggtaaccggggtaaacccggtaaacgggtccgttaacccgggtaccccggtttacccggtaacggggtacccgtaaccgggtacccccggtaaacgggtccccgtttaccccgggtcccccccgtaccgggtttacccccgg

SEQ ID NO: 150953 - DNA, 666 bp, Homo sapiens
  misc_feature: GYAE6OF01BXEKR.7.5.A05.1.454.CMB.1.raw
  modified_base (503)..(503): a, c, t, g, unknown or other
  misc_feature (503)..(503): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctcgtgtctggtctcctggacagtcgatccaccatcctcctgcactacggaacccaccactcgacgttgcttagttaataatatctactccgtagtactacaacaactacccgagaccaaacgcccctaaagtcactactatttagtagattcgtacttaataacgttccggtcctttacggtacggggttttacctaacgtcgttacctttccttcgtacggtccctaccgtaagtccgtacggaccgaccgtacccgtcccctcccgtacgaccctatccgtcgtcggtcctcgagcgtagacgacgagcgtagtattactacgtcgtacncgtcttactatagtacgacgacacgtacgacgtacctacgtacgttacgggtttacggaccgggtaacggaccgaacggtccgttaacgtaccggttccggaccggttaccgaccgggtaacccaacggttcccgccccgttaccccgttccgggtaaccccg

SEQ ID NO: 150954 - DNA, 939 bp, Homo sapiens
  misc_feature: GYAE6OF01A1AYF.7.5.A05.1.454.CMB.1.raw
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctcgccctgacctcagcctcgcctccgtgtctggtctccgtgacngtcgatcacctatcctcctgcacgtcggaaccacctactcgtacgttgcttagttaataaactctcctctctgtactacaactaactacccgaggaccaaaccgaccccaagtcatactatttagtntattcgtataacgtaacgtccgtacgttacggttaacgggtttaccaacgttcgtctttccgtcgtcgtacctaccgtaagttcgtacggaccgaccgtcccggtccctcccgtacgtaccctacttccgtaccggtcggtacccgtaccggtacggtacgtaacggaaaccggtaccggtaacggttaccgtttaacggtttaacgtttttaaaccgttaccgtaccggtaaccgtaacggttaacccttaacgttaaacgtttaaacggttaacccgggaaccgggttaacccgtaaaccggggtcccttaaaccgggttaccccgttaaccggggtttttaacccggggttttaaccgggggttttacccccgggggaaaccggggggtaaaacccgggttaaacccccgggttaaacgggttacccccgggtttaaaccccggggtttaaacccccgggtttaaccccggggttaaacccgggggtttaaacccccccgtaaaccccgggggttaaaccccccggggtaaccccgggggtttaccccccccggttccccccccggggtttaaaccccccccggggttttcccgggtttaaacccccccccgg

SEQ ID NO: 150955 - DNA, 616 bp, Homo sapiens
  misc_feature: GYAE6OF01CB3PQ.7.5.A05.1.454.CMB.1.raw
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
  modified_base (572)..(572): a, c, t, g, unknown or other
  misc_feature (572)..(572): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtggcccagtctcgccctgacctcagcctgcctccgtgtctgggtctccgtggacagtcatcacatctctgcacgtcgaaccaccactgacgttgcttagttaataatctctctcctgtactacaacactaccaggacaaacgccccaatacatctatttatagtatcgtactataacgtccgtacttcgtacgggttctaatccgtcttctcgtcgtactaccagttcgtcggacaccgtaccggtccctaccgcacctactcgtacgtcggtcctaccgaggtactaggaacgacgtacggtctagttatttacgtacgttcgcgtaacgtccttanaacgttactaacggtanacggactacgacgctacgtccggtttacggttccgggacgggtacggaaccgtacggtcgtaacgccggttaccgngaacccgcggtaaccgtacggtccctcccgtccccgtcggtccc

SEQ ID NO: 150956 - DNA, 642 bp, Homo sapiens
  misc_feature: GYAE6OF01EPTLT.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactcggaaccaccactgacgttgctggttaataaatactctctctggtatcaacactaccagacaaacgaccccaaagtcattcatttatagtatgttactaataacttcggtaccttcgtacgggtttaccaattcgtcttctcgtcgtctacctaagtcgtgaccgtacgaccgtccctaccgtacgacctacgtcctcggtacggccttccgaggtcgtacggaacgacggacggtactagtaatttacttactcgacctacgtctaacgtattaacgtacgtacggacgaagtaccgacgtaccctacgtacggttacggggtttccgggaccgggtaaccgggtaaccgaacggtccgtacggtacccggtccgtacgtacgaccgtacccggacgtcccgtccggtccccccgtcggttacccg

SEQ ID NO: 150957 - DNA, 585 bp, Homo sapiens
  misc_feature: GYAE6OF01BW99Z.7.5.A05.1.454.CMB.1.raw
  modified_base (206)..(206): a, c, t, g, unknown or other
  misc_feature (206)..(206): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcncctgcactggaaccacactgacgttgctggttataaatatctctcctggtatcaacaatacccaggcaaagccccaaaagtcatcatttatgatgtctataactcggacctnagggtttacgaacttacgcttcttctcggtctcaacgtctcggcgacgacggtccncctcgacaactctcgtcgggtcncgacgcgtacgaacgaacggacggacgtagtaacgttaattaacgtcgtacgacgtacgtactactaagtaacaacggtcaagacacgtacacctacggtacggtttcggtacgggacgggtaacgaacggtcgtacggtaccgtaccgtacgttacgacgtaccgaacgacgccgccccgtccggtc

SEQ ID NO: 150958 - DNA, 738 bp, Homo sapiens
  misc_feature: GYAE6OF01D0AJR.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtcgggcccagtctcgccctgactcagcctgcctccgtgtcgtcgggtcctccgtggacagtcgatcacctatcctcctgcacgtacggaacccaccacgtcgtacgttgcgttagttaataactactcctctcgtagtactacaacaactacccgagaaccaaaccgaccccgaaacgtctaacttctaatttagtagtattacgtactaacgttacgtccggtaccgtttacggttacgggtttaccctaacgtccgtacttccgtcgtcgtactaccgtaacgtccgtcggaccgaccgtaccggtcccctacccgtacgtacctacgttccgttccggtcgggtccctaccggacggtacgtacggaaacgggtacgtaggtacgttaggtaacttttacgttacgacgtcctaacgtctaatactacgtaaccgacggaccaacggccgtaacgtacttaccggtacgggtttccggggttacgggaccgggaacggtaaccggtacgtccggtaaccgggtacccgtacggtacccgtacgacccggtaaccgtaccggacccgtccccggttccccgtacggttaccccg

SEQ ID NO: 150959 - DNA, 648 bp, Homo sapiens
  misc_feature: GYAE6OF01CFVO5.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctctgcactcggaaccaccactgacgttgctggttaataatatctctcctgtatcaacaactaccaggacaaacgaccccaagtcatctatttatgatgtactataactcggtcttcgtagggttccatcgtcttctctcgctcagtcgtgcacgaccggcctacccgtgacctatcgtcgcggtctaccgcggctaggaacgacggtaggcttagtactttacttaaccgtcgactacggtacctacgtaactaacgtaaccgtacggaccacgtacgacgtacctacggttacgggttaacgggttttccggggaacggggtaaccgggtaaccgtacggtccggttacccgggaacccggtttcccggtaacggtacccgtaacccggacccggtaccgggtacccgttcccccgggttcccccgtccggttaccccg

SEQ ID NO: 150960 - DNA, 549 bp, Homo sapiens
  misc_feature: GYAE6OF01AZ5KW.7.5.A05.1.454.CMB.1.raw
  modified_base (368)..(368): a, c, t, g, unknown or other
  misc_feature (368)..(368): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcaccatctcctgcactggaaccaccactgacgttgctaggttataaatatctctcctggtatcaacaatacccaggcaaagcccccaaagtcatcatttatgatgtctataatcgtcttcgagggtttccaatcgcttctctgctcaagtctggcgacacgcctccctnaccatcctctcggctccgaggctgaagcgaggctagatttatctcgcagctacataatacgaggctagcagcaactcgtagggttttccggacgggtacgggaaccgaagtccgtggtaacccgtcccgtaaggtccaaccggacccgtaaggtaccgtcgtccccccgtcggttaacccg

SEQ ID NO: 150961 - DNA, 715 bp, Homo sapiens
  misc_feature: GYAE6OF01CYDZI.7.5.A05.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtcgggcccagtctgccctgactcagcctgcctcgtgtctgggtctcctgacagtcgatcacntctcctgcacgtcgaaccacacgtgacgttncttagtaataatntcttctccgtagtactacaacaactaaccagacaaaccgaccccaagtcatctatttangatgtactatagtcgtcttcgtaggttcatcgtcttctcgtcgtctacgacgttcgtcggaccgaccgtcccgtcccttcccgtacgtaccctagttcccgtccggtacgggtaccctccggacggtaccggtaacggaaacggtacgggtaaccggtacgtttaggttacgttttaacgttaacggttaggacccttaacggttacctaacttaacgtacgtaaaccgacggaccgtaacgacgtaccggtacgttaaaccggttcgggtttaaccgggtttccgggaaccggggtaaaccgggtaaccgaaccgtccggtaacccgggttaccgtaaccggttaccggtaccaacccggtccccggaaacggttccccgtaccccggtccccggttccgttaaccccg

SEQ ID NO: 150962 - DNA, 524 bp, Homo sapiens
  misc_feature: GYAE6OF01BQKXH.7.5.A05.1.454.CMB.1.raw
  modified_base (296)..(296): a, c, t, g, unknown or other
  misc_feature (296)..(296): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataatatctctcctggtatcaacaatacccagcaaacgccccaaagtcatcatttangatgtctataatcgtccttcgagggtttccaatcgtcttctctgctccagtctggcgacgacgcctccgtgaccatctcgtggcctccgaggctagaacgacgaggtctagtatttattactgacagtctacatataacgagcagcagccactcgtaggtttcggacggaggaccaagctacggaccgtccgagtccgacgcccgacgcctccgtccccgtggtaccc

SEQ ID NO: 150963 - DNA, 693 bp, Homo sapiens
  misc_feature: GYAE6OF01BR6CJ.7.5.A05.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctcgccctgactcagcctgccctccgtgtctgggtctccgtggacngtcgactcacatctcgtgcacgtcggaaccnccactgtacgttgctagttaataaatntctctcctgtatacaacaactaccgagacaaaccgacccctaagtcatactattatgattgtactatacgtccgtccttacgtacgggttactacgtcgtctctcgtcgtcctacgtagtcgtcggaccgaccgacccggtccctccgtacacctacttccgtcgtcggtccgtccgacggtcgtaacggaacggaacggtacggtacttacgttaactttacgttacgtcgacgtacgtacgttacctaagtacgtacgaacgggtaccgagtaccgaccggtacccttacgggttacccggtttacgggggttaccgggaccggggtaaccggaacccgaccggtaccggttaacccggtacccggttacgaaccggttccgaacccggacccgtaccggtcccggttccccggtcccccgttaccgggtaccccg

SEQ ID NO: 150964 - DNA, 627 bp, Homo sapiens
  misc_feature: GYAE6OF01BQQH5.7.5.A05.1.454.CMB.1.raw
  modified_base (235)..(235): a, c, t, g, unknown or other
  misc_feature (235)..(235): n is a, c, g, or t
  modified_base (490)..(490): a, c, t, g, unknown or other
  misc_feature (490)..(490): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttnctggttaataatatctctctgtatacaacaactaccaagacaaacgaccccctaaagtccatactatttatagtatagtactaagtaacgtccggtcctttacggtacgggtttacctaagtccgtaccttcctcgtcggaccttacctaagtccgtacgggacgacgaccggtccctccgtcacctactctcgtgggtcctacgagctagaacgacgacggtctagtattacttactgtacagactacaattanacgtagacgtagactacgacgtacgtacgttacgggtttaccgggacgggaacgggtaaccgaacggtaccgtacggacccgttcgacggttaccgaccgtacccgaacgggcccttacccggtccccgtcggtacc

SEQ ID NO: 150965 - DNA, 555 bp, Homo sapiens
  misc_feature: GYAE6OF01AIR8E.7.5.A05.1.454.CMB.1.raw
  modified_base (375)..(375): a, c, t, g, unknown or other
  misc_feature (375)..(375): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacaggggtcgtgggcccagtctgccctgactcagtcctgcctccgtgtctgggtctcctggacagtcgatcaccatctcctgccactcggaaccaccactgacgttgctggttataaatatcctctcctgtatcaacaatacccaggcaaacgcccccaaagtcatcatttatgatggtctataatcggtccttcgacggggtttccaatcgtctttctcgtggcttaccaagtctcggcgaccncggccctcccgtcgacctactcctctcgggctccgaggcctgaacgacggaggcttagatttaacttactgacagctcatactacgaggacagccagcactctaggtttcggcggacggacaacggcgtacggaccgtccgtaggtcaccggtaccgacgccgtccgccccgtcgtcccg

SEQ ID NO: 150966 - DNA, 671 bp, Homo sapiens
  misc_feature: GYAE6OF01CNFHI.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactggaaccaccatgacgttgcttggttaataatatctctcctgtatacaacaactaccaggacaaacgccccaaagtcactctacttatgatgtctatactcgtccgttcgtagggttacaatcgtcttcgtcgtcgcctacgaacgtcgtggaccgaccgtaccgtccctcccgtagaccctacgtcctccggtcgggtccttaccgacgggtcgtacggtaacgaacggtacggtacttacgttactttaacgtttacgtacgtcgtagtacctactaattaacgtaccgtaaggccgaacggtcctacggacgttaaccgttacggttacggggtttcccggggaacgggtaccggaaccgtaacggtccgttaacccgggttaccgtaccggtacgggtaccgaaccgggacccggtaacggtcccgccccggttccccgtccggttaccccg

SEQ ID NO: 150967 - DNA, 540 bp, Homo sapiens
  misc_feature: GYAE6OF01C35DW.7.5.A05.1.454.CMB.1.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (460)..(460): a, c, t, g, unknown or other
  misc_feature (460)..(460): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatatctctcctggtatcaacaatacccaggcaaagcccccaaagtcatcatttatgatgtntataatcgccttcagggtttccaatcgcttctctggctccaagtctggcgacncggcctccctcgacctatctcgtggcctcnggctagaagacgagctagattattaccgtgcagctacatatacgaggcagcacgcaactcgtagggtttccggnggacgggtacgaacgcgtacgacccggttcgtacggtacaccggacccgaaggtccctccgtccccccgtcggttacccg

SEQ ID NO: 150968 - DNA, 658 bp, Homo sapiens
  misc_feature: GYAE6OF01C0LL6.7.5.A05.1.454.CMB.1.raw
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
tcagcgtgtctctacacgaccggtgctcgatttagatagatagacgaggggggggtctcaggaggcagcgctctcgggacgtctccaccatggcctgggctctgctattcctccaccctcctcactcgagggcacgagggtcggtcgggcccagtctcgccctgactcagcctgcctccgtgtctgggtctccgtggacagtcgatcaccatcctctgcacgtcgaacccaccactgacgttgcttaggttaataatntctctcctgtatacaacaactaccagaccaaacgaccccaaagtcatactatttatgtatntcgtaatagtccgtccttagtacgggtttcaacgttcgcttcgtctcgtctccgaagtcgtggacgaccgccgtcctccctagtacctactcgtcggtcggccgtaccgacggtcgtagaacggtacgacggtactagttattaagttacgtcgacctagtcctactaattaagtaacgacggtacgacggacgaacgtccgtaacgttcgggttacgggttttaccgggacgggaccgggtaaacgacggtaccgttaccgtaacccggttccggtacggtacccgtaaccgacccggtaacggtacccgtaccccggtccccgttccggttaccccg

SEQ ID NO: 150969 - DNA, 551 bp, Homo sapiens
  misc_feature: GYAE6OF01BBTJV.7.5.A05.1.454.CMB.1.raw
  modified_base (298)..(298): a, c, t, g, unknown or other
  misc_feature (298)..(298): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactggaaccaccactgacgttgctggttataatatctctctgtatcaacactaccagacaaacgaccccaaagtcatctatttanagtatgttactaataacgtccggtccttacgtacgggtttacctaacgtcgtcttctctcgtctacgtacgtcgtggccaccgaccggccctcccgtcgacnctctcgtcggctccgngtcagaagacgagctagtattatacgngacgcntacatactacgagcagcacgctacgtcggtggttccggaggtcggactacgtcgtgaccgtcgacgtcgacgacccgacgtcccgtaccgtcccgtcggtcc

SEQ ID NO: 150970 - DNA, 632 bp, Homo sapiens
  misc_feature: GYAE6OF01BQ7SC.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcgtggacagtcgatcaccatcctcctgccactcggaacccaccactgacgttgcttaggttaataaatctctctcgtggtatacaacactacccaggacaaacgaccccaaagtccatctatttatgtatgtctataactcggtccttcgtacgggtttctaacgtcgtccttccgtctcggtctaccgtaagtcgtacgggccgtacgacccggtccctcccgtcgaccgtatccgttcgtcggtctaccgaggtcgtaggaacggtacgaggtctaggtattaacgttacgtgtctaatcctactactaactaacgacggacagtcgactctaccgtacggttcgggttacggacggggtaacggaaccaggtccgtaggtaccccgtacgtacgggtacaccggacccgacgggtcctccccggtccccggtacggtaccccg

SEQ ID NO: 150971 - DNA, 629 bp, Homo sapiens
  misc_feature: GYAE6OF01ENQQE.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttaggttataaatntctctctggtatacaacaataccaggacaaacgaccccaaagtcatcatttatgatgtactataacgtcggtccttcgtaggggtttcctaatcgtcctttctcgtggtctaccgtagtctggcgacgacgccctccctcgacctagttcgtctgggcctaccgaggtctaggaacgacgaggctacgtaatttacttacgtcgtactagtctactactaagtaaccgaggacgagtacacgtacgtacgttaccgttagggtttaccgggacgggacggggaaacccgtaacggtcccgttacggtaaccccggttccgtaacggtcccgtaacgaccccggtaacgggtcccttacccggccccccggttcggtaccccg

SEQ ID NO: 150972 - DNA, 780 bp, Homo sapiens
  misc_feature: GYAE6OF01DIWBR.7.5.A05.1.454.CMB.1.raw
tcagcgtgtctctacacgaccggtgctcgatttagatagatagacgagggggggtctcaggaggcagcgctctcgggacgtctccaccatggcctgggctctgctattcctcaccctcctcactcagggcacgagggtcgtgggcccagtctgccctgactcagcctgcctcgtgtctgggtctcctggacagtcgaatcacctatctcctagctactggaaccacgactgacgtgtcttaggttaataatatctctccgtggtactacaactaactaccaggacctaaacgaccccaaagtccaattacgtaatttatgacttagtactaagtaacgtcggtccgtttacgtacgggttttaccaagttccgtctttacctcgttcggaccttaccgtaacgtcgtacggccgtaaccgacccggtccctaccgtacggtacctaacgtcgttaccgtcgggaccttccgacggtcctaagggtaaacggtaccggtaggacgtttacgtaacgtttaacgtttacggtacgtacgtaacgtaccttaactaacttaacggtaaccgaacgggtaccacgggtacgtaaaccggccgttaaccgtttacgggttaaaccgggttttccggggaaccggggaaacgggttaacccgaaaacggtcccgtttaacccgggtaacccgttacccggttaacgggtaccccgtaaacccgggtacccgtaaaccgggttccccgtaacccccgggttaaccccccttcgggggtttaaccccc

SEQ ID NO: 150973 - DNA, 653 bp, Homo sapiens
  misc_feature: GYAE6OF01E3J5I.7.5.A05.1.454.CMB.1.raw
  modified_base (493)..(493): a, c, t, g, unknown or other
  misc_feature (493)..(493): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaacccaccactgaccgtttgcgttggtttaataaatatctctctggtactcaacaactacccaggacaaacgaccccaaagtcatcatttatgatgttctataagtcggtccttcgtacggggtttaccaacgttcgtacctttctcgtcggtcctaccgtaagtcgtacgggaccgaacgaccggtccctacccgtcgacctactcctcggtcgggcctaccggacggtctagaagatacggaggtctagtatttagttacgtcgacacgtactntaactacaacgacggcacggtacacgtccacgtttcgtacggggttttccgggacggggtacgggaacccggtaaggtccgtacggtacccggttccgtaacgggttaccgaacccggaccccggaacgggtcccgtaccccggtcccccggttacccgg

SEQ ID NO: 150974 - DNA, 671 bp, Homo sapiens
  misc_feature: GYAE6OF01D0N20.7.5.A05.1.454.CMB.1.raw
  modified_base (346)..(346): a, c, t, g, unknown or other
  misc_feature (346)..(346): n is a, c, g, or t
  modified_base (417)..(417): a, c, t, g, unknown or other
  misc_feature (417)..(417): n is a, c, g, or t
  modified_base (526)..(526): a, c, t, g, unknown or other
  misc_feature (526)..(526): n is a, c, g, or t
tcagcgtgtctctacacgaccggtgctcgatttagatagatagacgaggggggggtctcaggaggcagcgctcgtcgggacgtctccaccatggcctgggctctgctattcctcaccctcctcactcgaggcacgagggtcgtcggcccagtctcgccctgactcagcctgcctccgtgtcgtgggtctccgtggacagtcgactcaccatcctacctgcacgtacgaacccacctactgacgtttcgacgttaggttaataaatctaccttctccgttaggttactacaaacaacctacccgaacggtaaccaaaccgacccctaaagtcacttactagtttagngtatcgtactagtaacgtcggtcttacggtacgggttaccactcgtcctcgtcgtcggtctacgtagtcgnggaccgtacgaccgcccttcctcggaccttacgtccgtcggtcggtacctcggacggtacgtaggaacggacgtaccggtgttacgtactttagtccgtacgcgttacncgtactaattacgaaccggtaggacgtagaccgtacgtcgtacgttcggttacgggttaccgggaggaccggtaacgtacggtacgtaccgtaccggttcgcgtaccgtaccgaccgtaacgcccgtcccgtcccgtcggtaccg

SEQ ID NO: 150975 - DNA, 721 bp, Homo sapiens
  misc_feature: GYAE6OF01DEVRS.7.5.A05.1.454.CMB.1.raw
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttaggttaataaattntcctctccgtgtactacaacaactaccgaaggacaaaccgaccccaaagtcatctatttangtatntatatatcgtcttcgtacgggttccaatcgtcttctcgtcgtctactaagtcgcggtcacgaccggcccttccacgtaccctagttccgtacgtcgggtcctaccgtacggtacgtaggaacggtacggaacggtacttagttaactttacgttaacgtcgacctaaggttctaaccgtaagttaccgtaaacgccggtaacgacggaccgtaaccgtccgtaacccggttttcgggttaaccggggttttacccggggaacgggtaaaccgggggtaaccctaacgggttacccgtaacccgggttcccgtttaacccgggtaccgggtttaacccgaaccccgggtaaccccggtaacgggtcccccgttacccccggtacccccggttccgttaaccccg

SEQ ID NO: 150976 - DNA, 666 bp, Homo sapiens
  misc_feature: GYAE6OF01E26LK.7.5.A05.1.454.CMB.1.raw
  modified_base (408)..(408): a, c, t, g, unknown or other
  misc_feature (408)..(408): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcacgcctgcctccgtgtcgtgggtctcctggacagtcgatcacctatcctcctgcactcggaacccaccactgacgttgcgttaggttaataaatatcctctctgtatacaacaactaccaggacaaacgacccccaaagtcatactattttactagtattgtactaataacgtccggtccttcgtagggtttacctaatcgtcttctctcggctacctagtcgtggccgacgaccggccctcccgngacctactccgttcgtcgggcctccgacgggacgtacggaaacggaacgacggtctagttaatttacgtttacgtcgtacgacgtctactataactacgaaggactacgacgacgtacgtacgtaccgttacggggtttaccgggacggggtaaacggaccgtacggtacgttacccggtacccggtacccggttaacggaccgaacccggtacccgaaaccggtcccgtccccggttccccccgtccggttaccccg

SEQ ID NO: 150977 - DNA, 607 bp, Homo sapiens
  misc_feature: GYAE6OF01B4VPN.7.5.A05.1.454.CMB.1.raw
  modified_base (193)..(193): a, c, t, g, unknown or other
  misc_feature (193)..(193): n is a, c, g, or t
  modified_base (471)..(471): a, c, t, g, unknown or other
  misc_feature (471)..(471): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacaggggtcgtgggcccagtctgccctgactcagcctgcctcgtgtctgggtctctggacngtcgatcacatctcctgcactcggaaccaccactgacgttgctggttaataatactctctcctggtatcaacaactacccgagacaaacgaccccaaagtacactactatttatgatcgtactataacgtcgtcttcgtacgggtttccatcgtcttctctcgtctacagtcgtggcgacgcgccctccgtcgaccactctcgtcggcctccgacggtcgtacggaagacggacggtcgtagtatttacttacgtcgtacacggtctacgtacttaanacgtacggaccagactacggacctacgttacgttacgggttcgggtacgggacgggaaccgtaggtccgtacggaacccggttcgtacggtaccgaccggtaccgacggtaccctcccggcccgttcccgtacccg

SEQ ID NO: 150978 - DNA, 604 bp, Homo sapiens
  misc_feature: GYAE6OF01B6A65.7.5.A05.1.454.CMB.1.raw
  modified_base (305)..(305): a, c, t, g, unknown or other
  misc_feature (305)..(305): n is a, c, g, or t
  modified_base (497)..(497): a, c, t, g, unknown or other
  misc_feature (497)..(497): n is a, c, g, or t
  modified_base (582)..(582): a, c, t, g, unknown or other
  misc_feature (582)..(582): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctaggttaataaatactctctcctggtatcaacaactaccagaccaaacgaccccaagtcatctatttangtatgtctatactcgtccttcgtagggtttccatcgtcttctctggctcgtaagtcgtcggacgaccgtaccggccctccctcgaaccctacgtccgttcgtcgggcctcccggacgtcgtaggaaacgacgggaggtacgtagtatttaacgttacgtcgcgtactctactataactacgaggcagtccanactaccgtcgttagggtttcgggacggtaacggacgacgtcgtacgggacccgttcggtacgtccgaacgccggaacggtacccncccggtccccgtccggtacccg

SEQ ID NO: 150979 - DNA, 860 bp, Homo sapiens
  misc_feature: GYAE6OF01CCSEJ.7.5.A05.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccntctcctgcacgtcgaaccaccactgacgttgcgtaggttaataaattatctctccttggtatacaaacaactacccaggacaaacgccccaaagtcatcatttangtactgtactataactcggtccttacgtacgggtttaccaagttccggtctttccgttcgtcggtacccttaccgaaacggttccgtacgggtacccgaaccgacccgggtaccccttacccccgtacggtaacccccaacgtttcccgttaccggttccggggtcccgttaccccggtaacggggtaccgtttaacggggaaaacgggtaaccgggaaccgggtaaccgtttacggttaaccgttttaaatttaccgttacggaccgttaacggttacctttaaccgaaaagtttaacgtaaaccggtaacgggaaccggtaaccggtaaccgtaaacggtacccgttacccggtttaaccgggttaccgggggtttttaaacccggggaccgggggttaacccggggtaaaaccggtaaccggtacccggggttaccccggtaaccccggtttaacccggttaaccgggttaacccggaacccggaacccccgggttaacggtacccccgttaccccgggttcccccccggtaccggtttaaccccccgg

SEQ ID NO: 150980 - DNA, 759 bp, Homo sapiens
  misc_feature: GYAE6OF01A8LQQ.7.5.A05.1.454.CMB.1.raw
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
tcagcgtgtctctacacgaccggtgctcgatttagatagatagacaggggggggtctcaggaggcagcgctctcgggacgtctccaccatggcctgggctctgctattcctcaccctctcactcagggcacaggggtcgtgggcccagtctgccctgactcagcctgcctcgtgtctgggtctctggacagtcgatcacatctcctgcacgtggaaccactactgacgttgctaggttaataaatntctctctgtatcaacactaccaggacaaacgcccaagtcatctattanagtatgtactagtacgtccggtacctttacggtaccgggtttaccaacgttcgtacctttccgtcggttacggtaccttaccggtaaacggttccgtacgggtaccggaaccgtacccggggttacccctaccccgtacggtaacccctaagttcccgttcggttaccggggaccttacccggacgggtccgttaacgggaaacggtaaccgggtaggtaccgttaggtaaccttttactttacggaccgtacgtaacgtccttaactaacgtaacgttaaaccggaggtaccgtaacggaccgtaacgtacgtaaccgggtttacggtaacggggtttacccgggacgggtaaaccgggtaacgtaacggtaccggttacggaacccggttcccggtaacggtacccggtaaccggtacccggtaacggtcccggttccccggtcccccggttcggtaaccccg

SEQ ID NO: 150981 - DNA, 746 bp, Homo sapiens
  misc_feature: GYAE6OF01CR3C8.7.5.A05.1.454.CMB.1.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactggaaccaccactgacgttgctggttaataatntctctctgtactacaacaactacccaggacaacgaccccaagtcatctatttangtatgtactataactccgtccttacgtacgggttacctaacgtcgtcttctcgtcggtacctaccgaagttccgtacggtccggaaccgtacccggcccttaccccgtacgtacccctacgttccgttaccggtcgggtccctacccggtaggtaccgtaacggtaaacgggtaacggtacgggtaaccttaggttaacctttaagtttaaccggtaccgtactacggttaccctacgttaaccgttaacgtaaccggaacggtaccaacggtaccaacggtaccgtacccggttacggttaaccggggttttccgggaacggggtaaccggggtaaccctaaacgggtcccgtacgggttaaccccggttccgtaaccgggtccgaacccggacccggtaaccggtcccgttcccccggtcccccgttccggttaacccccg

SEQ ID NO: 150982 - DNA, 643 bp, Homo sapiens
  misc_feature: GYAE6OF01AK9DY.7.5.A05.1.454.CMB.1.raw
  modified_base (220)..(220): a, c, t, g, unknown or other
  misc_feature (220)..(220): n is a, c, g, or t
  modified_base (517)..(517): a, c, t, g, unknown or other
  misc_feature (517)..(517): n is a, c, g, or t
tcagcgtgtctctacacgaccggtgctcgatttagatagatagacgagggggggtctcaggaggcagcgctctcgggacgtctccaccatggcctgggctctgctattcctcacctcctcactcaggcacagggtcgtggcccagtctgccctgactcagcctgcctccgtgtctgggtctccgtggacagtcgatcaccatcctcctgcactggaaccncactgacgttgcttggttactaaatgtccttctcctggtactcaacgaactcgacccaggccaaaacgccccctagaaacgtcacttctaagtttgtagctctacctagtaccgtcgttccgttacggttacgggtttaccacgttccgtcttccgtcgcggtcctaacgtacggttcgcggtaaccgcgtaccccggtctacccgttacgaacccgttctccgtccggtcggttaaccctcggacggtcgacggaaacggcggtacgtacgtacgttaacgtttcgtccgtggacncgtacctagtacttacgaccggagccagcctagacttcgtacggttagggtaccgggacgggtacgaacgtccgtgtacccgtaccgttcaccgcgtaccgaccgaccgtccgcccgttaccccgg

SEQ ID NO: 150983 - DNA, 695 bp, Homo sapiens
  misc_feature: GYAE6OF01B92Q4.7.5.A05.1.454.CMB.1.raw
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactcggaaccaccactgacgttgcttaggttaataaatntctctcgtgtatcaacaactaccgaggaccaaacgccccaaagtcactctatttangtatgtactaataacgtccggtccttacgtacgggtttaccaagttcgtcttctcgtcggtctaccgtaagttcgtacggcgtaaccgtaccgggtccccttaccccgtacggtacccctaacgttcccgttacggtacgggtccctacccggtacgggtaccgtaacgggtaaacggaaccgggtacggtaccgttaagttaacgtttacgttacgtacgtacgacggtactactaagttaacgtacgacggtacgaacgtacgacgtacgtacgttacgtacgggttttaccgggacggggtaacggaaccgtaacggtcgttaccggaccgttcggtacggtaccgaccgaccgtaacgggtccctccccggtcccgtcggtacccg

SEQ ID NO: 150984 - DNA, 711 bp, Homo sapiens
  misc_feature: GYAE6OF01BQ0M8.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaatatctctctgtatcaacaactaccaggaccaaacgaccccaaagtcatctatttatgtatgtactaataactcgtccttcgtacgggttacactcgtcttctcgtcgctactaacgtcgtggccgacgtcccggtaccctcccgtacgacccgtacttccgtaccggttcgggccttacccggagggtaccgtacgggaaacggtaacggacgggtacgttaagtaacgttttaattaccgtcggtactaacgtccgtaacttaacgttaaactaccggacggtaccacgggtaccaaggtaccctacggtttaccggtttacgggggttttacccgggggaaccgggtaaaccggggtaacccgtaacggtccgttaaccgggtaccccggttaccggtaaccgggtacccgaccggtacccgacggtccccggtcccccggtcccccgttccgggttaccccg

SEQ ID NO: 150985 - DNA, 806 bp, Homo sapiens
  misc_feature: GYAE6OF01AF741.7.5.A05.1.454.CMB.1.raw
  modified_base (225)..(225): a, c, t, g, unknown or other
  misc_feature (225)..(225): n is a, c, g, or t
tcagcgtgtctctacacgaccggtgctcgatttagatagatagacgaggggggggtctcaggaggcagcgctctcgggacgtctccaccagtggcctgggctctgctattcctcaccctcctcactcgagggtcacgaggggtcgtgggcccagtcgtggcccctggactcgagtcctgcctccgtgtctgggttctccgtgggacagtcgatcaccatctcctncacgtggaaccacactggacgttgacttaggttaataaatcttcctcgtccgtaggttactacgaaactaactacccaggacaaacgcccctaaagtcaagtactatttagtagtactagtactaataacgtcggtacgtttacggtacgggtttaccaacgttccgtacctttccgtcggttacggtacccttaccgtaaacggttccgtcgggaaccggaccgtaacccggtccccgttacccgttaacggtaacccttaccgttacccggttaccgggtcccggggtacccttaccgggaacgggtaccggttaacggaaaaccgggaaccggtaagggtaccgttaaggtttaaacgttttaaaccgttaacggtcccgggtaaccgtaggtacccgttaaccgtaaacggttaaccttaacggaacgggtaccgaacgggaaccgtacgtacccgttaaccgttcccgggttaacgggtttccgggacggggtaaccggaacggtacggtccgtacggtaccggttacgtacgacgacgtacccgtacgtacccgtcccgtcccgtcggtaacccg

SEQ ID NO: 150986 - DNA, 736 bp, Homo sapiens
  misc_feature: GYAE6OF01D3J40.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtggcccagtctgccctgactcagcctgcctcgtgtctgggtctcctggacagtcgatcaccatctcctgcactcggaaccacactgacgttgcttaggttaataaatactctcttccgtaggtactacaaacaactacccaggaccaaacgaccccaaagtcatactatttatgtatgtactaattaacgtccggtacctttacggtacggggtttacctaacgtccgttcttcctcgtcggtctaccaagttccgtacggaccgaaccgacccggtccctaccctagaaccctacgtccttccgggtcggggtaccttacccggacgggtcgtaagggtaaacggacggtacggtacttaaggttaattttaacgttcgtacgtcctaacgtcttaacgtataacgtaacgaacggacctaaggccgtaacgtccgtaacgttaccgggttacggggtttaaccgggaccgggtaaaccgggtaaccgaacgggttccggtacggtaaccccgggttccgaaccgggttcccgaacccggtaccccggaaccggttcccggttcccccggtaccccccggttcggttacccccg

SEQ ID NO: 150987 - DNA, 695 bp, Homo sapiens
  misc_feature: GYAE6OF01B3NTW.7.5.A05.1.454.CMB.1.raw
  modified_base (474)..(474): a, c, t, g, unknown or other
  misc_feature (474)..(474): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccacgtagtacgtcgtcgtagttaaataattctcctccgtcgttagtactaaccaaactaaccaaccggacgtaacaaacccgaccctaacgtctactactttaagtttagtacgtacgttgtaactaagtaaccgtcccgttaccgtttacgggttaccggttaactactcgttcttcgtcgtcgtcctacgtacgtcggcgaccgtaccgcccgccctactaccactctccgtcggtaccgccgtacgngacggtaagaaccggtaggtacgtacgtagttaactttacgttacgcgtacgtcgtacttaacattaacgccggtagacgacgaacgttaccgaaccgttcgttaccggtttaccgggtcgggaacggggtccgaaactcgtcccggtacggtacccgttacggacggtaacccgaccggaacctacccgggcccgttccccctcccgggtacgtaccccg

SEQ ID NO: 150988 - DNA, 720 bp, Homo sapiens
  misc_feature: GYAE6OF01CTFWX.7.5.A05.1.454.CMB.1.raw
tcagcgtgtctctacacgaccggtgctcgatttagatagatagacgagggggggggtctcaggaggcagcgctctcgggacgtctcccaccatggcctgggctctgctattcctcaccctcctcactcagggcacgagggtcgtgggcccagtctgccctagacctcagccctgccctccgtgtcgtgggtcctccgtggaccaggtcaactcaccatcctcctagcacgtacgaacccaccatgacgttcgacgttaggttaactaaatctcttcttccgtaggtaatacaaacaaacgttaaccaacggaccaaaacgacccccaaagtacaattactatttatagattgtacctaataagtcgtaccgtttacgtacgggtttaccaagtacctcgttcttcgtcgacctacgtaagtccgtaggaccgaccgtaccggtaccctacccgaccgtaacgtactcgtacgttcgggaccgtcccgtagacgtagaacggacgaacggacttagaactttactacgtgactacgtactactagttaacgtaacgacgtacaacgtcgaacgtaccgtacgtaccggtttacgggtttaccggggaaccgggtagggaaacccgaacgggtcgttaacccggacccggttacgttaacggtacccgaacgtaccccggtaaacgtcccggttaccccgtccccgggttccctaaccccgg

SEQ ID NO: 150989 - DNA, 604 bp, Homo sapiens
  misc_feature: GYAE6OF01BPB7E.7.5.A05.1.454.CMB.1.raw
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgctggttataaatntctctctgtatcaacataccagacaaacgaccccaagtcatctatttatgtatgtctatatcggtcttcgaggttccatcgtcttctctgctcagtctcggcacgccgcctccncgtacctactcgtcgtcggtcctaccgcggctaggaacggacgaggtcctagtaattcttacgtgcacgtcctanaattacgtacgaagggccagaccagcctacgtacggttacgggtttccggggacgggaacgggtaacccgtaacggtccgttaccgggacccggttcccggttaacgggtaccccgacggacccggtaacgggtccccgttcccggtccccccggttccgggttacccc

SEQ ID NO: 150990 - DNA, 610 bp, Homo sapiens
  misc_feature: GYAE6OF01DAUPV.7.5.A05.1.454.CMB.1.raw
  modified_base (251)..(251): a, c, t, g, unknown or other
  misc_feature (251)..(251): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtggcccagtctgccctgactcagcctgcctcgtgtcgtgggtctcctggacagtcgatcaccatctcctgcactcggaacccaccactgacgttgcttaggttaataaatntctctcctaggtatacaacaactacccaggaccaaacgcccccaaagtcatactatttatgtatgtactaataactcggtcctttacgtagggtttccaattccgtcttctctggctacctagtcgtgcgacaccgcctcctnacntctntggcctccaggctagacgtacgagtctgtatttattactgctagtctactaatacgtaacgaggtacagtcgagtcctacgttcggttacgggtttaccgggacggggtacggtacccaaggtccgtaccggtacccggttccgtaaccggttccgaaccggtaccccgtaagggtccccgtcccggtccccccgttcgggttaccccc

SEQ ID NO: 150991 - DNA, 740 bp, Homo sapiens
  misc_feature: GYAE6OF01E1MFF.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctccgtgtctgggtctccgtggacagtcatcaccatcctctgcactcggaacccacactagacgttgctagttaataaatatctctcgtggtatacaacaactaccagacaaaacgacccccaaagtactatactaatttactgtactgtactaataacgtcggtacttacggtacgggttacctaacgtcgtaccttcgttcgtacgtacctacctaaacgttcgtacggtaccgaacccgtaccgggtaccccgttacccgtacgtaacccttacttccgttacgttccggggtacccttacccggaaggggtaaccgttacgggaaaacgggtaaccggtaacggggtaccgtttaggtaaacttttaagtttaaccgtacgtacctacggtaaccttacgtaaattaactaacggacggacgaacgtaccgacgtacaaccgttagggtaccggttacggggaaccgggtaaccgggaaccttaggacttacccggtacgttacccggtaacgggtacccgaaccgtaaccgacggtacccttaccccggtccccgtacggttacccg

SEQ ID NO: 150992 - DNA, 802 bp, Homo sapiens
  misc_feature: GYAE6OF01C1AHS.7.5.A05.1.454.CMB.1.raw
  modified_base (319)..(319): a, c, t, g, unknown or other
  misc_feature (319)..(319): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggaccagtcgatcaccatcctcctgccactggaacccaccactgacgttgcttaggttaataatctctctcctaggtactacaaacaactaacccaaggacaaaccgaccccaaagtcagtctaatttanagtattcgtactaagttaactccggtacctttacggtaacgggtttacctaagtccgtctttccttcggtaccgtaccgttacccgtaacggtttccgacggggtaccgaaccggtacccgggtcccccttaccccggttacgaccccttaccgtacttacccggttcgggtacccctaccggtaaccggtacgtacggtaaacggaccgggtaagggttaccgttacggttaattttacgttaccgtaacgtcggtaacctacgtaaccgtaaagttaacgtaacccgacgggtaaccgacggtaaccgccgttaaccgacggtttaccgggtttaccgggtttacccgggggtaacccgggtaacgggtaaccgtaacccggaccggttacccggttaccggtacccgggtttaaccgggaccgttaaaccgaaccccggtaccggtacccgttccccgtcccccggtacccggttacccc

SEQ ID NO: 150993 - DNA, 765 bp, Homo sapiens
  misc_feature: GYAE6OF01A3TNH.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacgaggggggggtctcaggaggcagcgctctcgggacgtctccaccatggcctgggctctgctattcctcaccctctcactcagggcacagggtcgtgggcccagtctgccctgactcagcctgccctcgtgtctgggtctccgtggacagtcgatccaccatcctcctgcacgtcggaaccaccactgacgttgctaggttaataaatntctctcctggtatcaacaactaccaggacaaacgccccaaagtcatctatttatgtatgtactataactcggtccttcgtacggggtttaccaacgttcgtcctttccgtacgttgggtacccttacccgtaaacgttccgtacgggtaccggtaacccgtaacccgggtccccgttcccccgttaccggaaccccttaacgttcccgttaccggtccggggtaccccgttaccccggacgggttacccgtttaacgggaaaaccgggtaaccgggaaccggttccggtaaggttaacgttttacgtttaccggtacggtacgtaaccggtaccttaactaacgttaacgttaaccgaaggtaccgacgtaccgtacggtaccctacggttaccggttacggggttttccggggaaccgggtaccgggtaaccgaggtccgtaacggtacccgttacgtaacggtcgaaccgtacccgacgggacccttcccggtccccgttggttaccccg

SEQ ID NO: 150994 - DNA, 801 bp, Homo sapiens
  misc_feature: GYAE6OF01AFVIA.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctcgtgtcgtggtctccgtggacagtcgatcaccatcctccgtgaccactacggaaacccacctacgtggtacgttgtcgttaggtttaataaatacttcctcctcgtgtactacaacaactaccgaggaccaaacaccccaaagtcatctatttatgtattgtacttaataacgtccggtcctttacggtacgggtttacctaacgttccgtcttctcgtcgtcctaccgtacgttcgtacggccgaccgtacccggtccccttacccgtacgtaccctacgttcgttccggtccgggtccctaccgggacggtacgtaacgggaacggaacggtacgggtacttagttaacttttacgttacgtccgtacgtacgttacctaacgttaactaaccggtaaggaacccggtacgaaccgaccgtaaaccggtcccgttaacggttaccgggtttaaccgggggtttcccgggggaaccgggaaacccggggtaaacccggttaaccggtcccgggttaacccgggtaaccccgggtttaccgggtaaacccgggtacccggtaaccccgggtacccggtaaccgggtaccccccgttacccccggtcccccggttccggttaacccccgg

SEQ ID NO: 150995 - DNA, 702 bp, Homo sapiens
  misc_feature: GYAE6OF01CG101.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctccaccctcctcactcgagggcacgagggtcgtcgggcccagtctcgccctgacctcacgcctgcctcgtgtcgtgggtcctcgtggactagtcgatcacctatcctctgcacgtacggaacccactacgtgtacgttgtcgttaaggttaataaattctcttcctcctaggtactacaaactaaactaccgaacggaaccaaaccgaccccaaagtctactactatttagtgtattatactaataacgtccggtacctttacggtaacgggttaccaacgttcgtcttcgtcgtcgacttaccgtaagtcgtcggacgaccgtcccggtccctcccgtactacctaccgtcgtcggtcggtcctacggtacggtacgtaacggaaggtacggtacgtacgttagttaactttacgttacacggtaccagtacctactaataacgtaaccggaggaccaacgactacgtaaccttacggtacggttaccggggttacgggacggtacgggaaccacggttacgaccggtacccgtcggtaacgtcgaaccgtacccgaacggtccctaccccggtcccgttcggtaccccg

SEQ ID NO: 150996 - DNA, 673 bp, Homo sapiens
  misc_feature: GYAE6OF01CUVIF.7.5.A05.1.454.CMB.1.raw
  modified_base (148)..(148): a, c, t, g, unknown or other
  misc_feature (148)..(148): n is a, c, g, or t
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
tcagcgtgtctctacacgaccggtgctcgatttagatagatagacagggggggtctcgaggacggcacgcggcttcctacggggacgtcttcccaacctagtggcctgggctctgctaattcctcaccctcctcactcagggctacgngggtcgtggccctaggttctgtccctgacctcgagcctgccttccgtgtctgggtctccgtggacgaggtcgagtcgacctagtccgtccggtancaacgtcgaacctccagtgacgttgccgttaggtaataatntctctcctagtactcaactaactaccaggacaaacgaccccaagtcctagtcgtattagagtatcgtactataatcgtcttcgtacgggttacaagttcgcttcgtcgtacgtccttactaacggtcgtcggtcgacgtaccggtccgtaccctacgacctatccgttcgtcggacctcgaacggctaacgaacgacgacgtcgtacgtactttacgtactacgcacgtctactagtacgtaacgcggacgacgtcgacgtactaacgtgttacgggttcgggacgaaccgggactaacggtcccttaacggtaccggtaaccgtacggtacccggaccggtacccggtaacgggtccctccccgggtacccccgttcggtaaccccgg

SEQ ID NO: 150997 - DNA, 708 bp, Homo sapiens
  misc_feature: GYAE6OF01A23U1.7.5.A05.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacngtcgatcacatctcctncactcggaaccaccactgtacgttgcgttaggttaataatatctctctgtatacaacaactaccagacaaacgaccccaaagtactactactatttatacgtattcgtactaataacgtccggtaccgtttacggttacgggtttacctaacgttcgtaccttcgtacgtcgacctacgtaacggttcgtacggacgaccgacccgtcccgtaccgtacgaccctacgtccgttacggtcgggtcctaccggtacggtcgtaacggaaacggtacgggacgtacgttagtaactttagtaccgtcgactacgtcttaataacgttaagtaacgacggtaacgtacgaccgtaacggtacctaacgggttacggttacgggttaccggggacggttaaaccgggaacctacggtaccgttaccgtaacccggttcggtaacggtaccaccgggttacccgacgggtcccgtaccccggtacccgttccggtaaccccg

SEQ ID NO: 150998 - DNA, 706 bp, Homo sapiens
  misc_feature: GYAE6OF01CJP9Z.7.5.A05.1.454.CMB.1.raw
  modified_base (521)..(521): a, c, t, g, unknown or other
  misc_feature (521)..(521): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcacagggtcgtgggcccagtctgccctgactcacgcctgcctccgtgtcgtgggtctccgtggacagtcgatcaccatctcctgcactcggaaccaccactgacgttgcttaggttaataatatctctctgtactacaactaactacccaagacctaaaccgacccctaaagtaccatacctatttactgattgtactattaacgtcggtcctttacggtaacggggtttaccaacgttccggtcttaccttcgtcgtaccttaccgtaacgtccgtcggaccgaccgtacccggtccctacccgtcgtaacctacgttccgtcggtccggtccctacccgaggtacttacgggaacgtacggacggtactaggttacttaacgttaccgngcgtacgcttacaattacgtaccgagtcgaacgtctaacgtacctacggttacgttaacgggggttccgggaacgggtaaccgggtaacccgtacgggtccttaccgggtacccgttacccgggtaacgtccgaacccggtacccggtacggtcccgttaccccggtcccccgttcggtaccccg

SEQ ID NO: 150999 - DNA, 736 bp, Homo sapiens
  misc_feature: GYAE6OF01DD865.7.5.A05.1.454.CMB.1.raw
  modified_base (137)..(137): a, c, t, g, unknown or other
  misc_feature (137)..(137): n is a, c, g, or t
  modified_base (169)..(169): a, c, t, g, unknown or other
  misc_feature (169)..(169): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (324)..(324): a, c, t, g, unknown or other
  misc_feature (324)..(324): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcagggcacgnggggtcgtcgggcccagtctcgccctgactcncgcctgcctcgtgtctgggtctcnggangtcgatcacctntctcctgcacgtcgaaccaccactgtacgttgacgttaggttaataaatctacctctcgtagtacacaaactaacctaccgagaccaaaccgaccccaaagtccattctaattangtatgtactagtaacctcgtccgtttacgtaacgggtttccacgtctcttcttacgcgtactacgtacgtcgtacgcgtaaccgcccggtccctcccgcgttaaccacgttccgttccgtacgggcccgtaccgtaacggtacgtaacggggtaaacggacggtaaggttaccttagggtttaacctttaacgttttaccgaccgtacgttacgtacctttaaccgtaataaccggtaaacgcggacccgtaaaggaccgtaacgtacgtttaccggttcgggttttaaccggggttaccgggacgggggtaaaccgggaacccttagggtacccgttaccgtacggtacccgttacgggactaccggaaacccggtaccgtttaccggccccgttcccgtccggtaccccg

SEQ ID NO: 151000 - DNA, 667 bp, Homo sapiens
  misc_feature: GYAE6OF01CM5SF.7.5.A05.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacgaggggggggtctcgaggaggcagcgctctcgggacgtctccaccatggcctgggctctgctattcctcaccctcctcactcagggcacagggtcgtggcccagtctgccctgactcagcctgcctcgtgtctgggtctcctggacagtcgatcaccatcctcctgcactcggaaaccnccactgacgttgcttaggttaataaatntctctcctgtatcaacaatacccaggacaaacgcccccaaagtcatactatttatgattgtctaattaacgtccggtcctttacggtacgggtttaccaacttccgtcttcctcgtcggacctaccgtaagtccgtgggaccgtacgtacccggtcccttacccgtacggaccctactccgttcgtacgggtcctaccgacggtcgtacggaaacggacggacggtacttagttaacgttttacttaacgtcgtaccgacttcctaactaactaacgttaccgaagggtaccaacggtacgacgtaccgtacgttcggttaacgggtttccgggaacgggtaccgggaacctaacggtccgtacggtacccgtccgtagcccgacgccgaacgtcccgtcccgccccgtgtaccc

SEQ ID NO: 151001 - DNA, 678 bp, Homo sapiens
  misc_feature: GYAE6OF01CQ1XC.7.5.A05.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (494)..(494): a, c, t, g, unknown or other
  misc_feature (494)..(494): n is a, c, g, or t
tcagcgtgtctctacacgaccggtgctcgatttagatagatagacgaggggggggtctcaggaggcagcgctcgtcgggacgtctccaccatggcctgggctctgctattcctcaccctcctcactcgagggcacgagggtcgtgggcccagtctgccctgactcagcctgcctccgtgtcgtggtctcctggacagtcgatcacntcctcngcacgtgaaccacatgacgttgctaggttaanaattctctctcgtagtatacaaacaactaccgagacaacgaccccaaagtcattactatttangtatgtactaagttaactccggtacctttacgtacgggtttaccaagttccggtctttcctacgtcggtacctacccgtaaggtcgttaacggccgtaaccgtaccgggtccctacccgtagtacctactccgtacgtcggtctacggacgtacgtaggaaacgcggagtcttagtacttacgttanggacctagtccttaagtaataacggtacgaacggtcaacggccgtaaacgtccgttaccgtacgggtttcggttaaccgggaccgggaacggaacctacgggtaccgtaccggtacccggttacggtaacgtccggaacccgtaccgtacggtacccgttaacccggccctttccgggtaaccc

SEQ ID NO: 151002 - DNA, 761 bp, Homo sapiens
  misc_feature: GYAE6OF01CJP4P.7.5.A05.1.454.CMB.1.raw
  modified_base (136)..(136): a, c, t, g, unknown or other
  misc_feature (136)..(136): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
tcagcgtgtctctacacgaccggtgctcgatttagatagatagacgagggggggggtctcaggaggcagcgctctcgggacgtctccaccatggcctgggctctgctattcctcacccctcctcactcagggcacngggtcgtgggcccagtctgccctgactcagcctgcctccgtgtcgtgggtcctcctggacagtcgatccgaccatcctcctgccacgtcggaacccaccactgacgttgactggttaanaatntctctcgtgtatacaacaactaccgagacaaaccgaccccaaagtcatctatttangatntactataacgtcgtccttacgtacggttaccagtcgtcttctcgtcgactacgaacgtcgtcggaccgaccgaccggtcccttacccgtacgtaccctattcccgttacggtaccgggtcctaccggtaacgggcgtaaacgggaaacgtaccgggaaggtacgttaaggttaactttaacgtttacgtacggtaaccgtacggtaccttaacgtaaacgttaacgttaaccggaacggaccgtacggtactaaaccggtccgttaaccgggttaccggttttacgggggtttacccgggaacggggttaaccggtaaacccgggtaacggtcccgttaacccgggtaccccggtttccgttaaccgggttaacccgacccgggtaaccccgttaccgggttaccccgtcccccgggttaaccccggttaccggttaccccg

SEQ ID NO: 151003 - DNA, 654 bp, Homo sapiens
  misc_feature: GYAE6OF01BWG1F.7.5.A05.1.454.CMB.1.raw
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatctcctgcactggaaccaccactgacgttgctggttaataaatntctctccgtgtatcaacaactaccagacaacgcccaaagtcatcattangntntntatatcgcttgtcggttacactcgtcttctcgtcgtctactagtcgtcggacgaccgaccggtccctcccgacgtaccactcttcgtcggtcctccgaggtcgtacggtaacggacggtaacggtctaggttaactttacgtttaactcggtacacgtccgttactaacgtacgttaacgacggaccgacggaacgtacgtaccgttacgttaccggtttaacgggggttttccggggacccgggtaacggaaacccgtacggtccgtacggtacccggttcggttaaccgggtaccgaacccggtacccgaaccgggtacccgtcccggttcccccgttcggtaccccg

SEQ ID NO: 151004 - DNA, 616 bp, Homo sapiens
  misc_feature: GYAE6OF01CI2TM.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtcctccgtggacagtcgatccaccatcctcctgcacgtcggaacccacacgtgacgttgcttaggttaataatactctctcgtagtactacaaacaactaccgagaccaaacgacccctaaagtcatctattatcgtatgtactaatactcggtcttacgtacggttacaatctcttcgtctcgctacagtcgacggacacgtaccgcctacctcgacctactcgtcgtcggcctacgagtcgtaggaacgacggtagtacgtagttatttactacgtcgactacgtcgtatatagacgagctagtaccacgtactacgtacggttacgggttcggacgggtaacggacctacggtccgtaccggttacccgtccgtaaggtcccgaacggtacccgtaacggtcccgtacccgtcccccggttcgttaccccg

SEQ ID NO: 151005 - DNA, 711 bp, Homo sapiens
  misc_feature: GYAE6OF01D6MU4.7.5.A05.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaacccaccactgacgttgcttagttaataatntctctcgtgtanacaacaactaccagacaaccgaccccaagtcatctatttatggatgtactaataacgtccggtacctttacgtacgggtttaccaacgttccgtctttccgtcgtcgaccttaccaacggttcgtacggaccgtaccgacccgggtcccctacccgtcgaaccctacttcgttccgggtcggtccctacccgagggtccaagggtaaacggaccggtaaggtcgttagttaacgtttaacgttcgtacggcacggtccttacacgttaacgacggtaccggacaacgggccacgtcgtaaccgttacgggttaccgggtttaccggggacggggaacgggtaacccgtaacggtccgttacgggaacccccgtttacggtaccgggtcccaaaccggtaccccggaacggttccccggtcccccggtaccccgttccggtaaccccg

SEQ ID NO: 151006 - DNA, 632 bp, Homo sapiens
  misc_feature: GYAE6OF01DB3NM.7.5.A05.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactacggaacccaccactgacgttgctaggttaataaatatctctctagtatacaacaactaccagacaaacgaccccaaagtcatcatttangtatgtactataactcggtccttacgtacgggttccaagtccgtnttcgtctgctacaagtcgtgacgacaccgccctcctacgacctatccgtcgtcggcctccgacggtctaggaacgacgagtcgtagtaattaacgttctcgctacgtctactaactaagtaaccgaggaccgtacgacaccgtactaccgttacggtacggggtttaccggaacggggacgggtaaccgacggtccgtaccgggttacccgttccgttaacgggtaccgaccggtaacccgtaacgggtccccgtacccggtccccgttccggtaaccccg

SEQ ID NO: 151007 - DNA, 632 bp, Homo sapiens
  misc_feature: GYAE6OF01BUH0J.7.5.A05.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
tcagcgtgtctctacacgaccggtgctcgatttagatagatagacgaggggggggtctcaggaggcagcgctctcgggacgtctccaccatggcctgggctctgctattcctcaccctctcactcagggcacgagggtcgtgggcccagtctgccctgactcagcctgcctcgtgtctgggtctccgtggacngtcgatcaccntctcngcactcgaaccncactgacgttgctaggttaataaacttntctctctgtatacaacactaccaggacaaacgacccctaagtcatacgtatttagngtatgttactaactacgtccgtacgttcgtacgggttaccaattcgtcttcgtcgtcggccttacaagtctacggaccgaccgccgtccctacctacgacctcgtacgtcgtcggacctccggagtcaaggacgacgtcgcttatacttatacgngtacgacgtnaacttagtacgtaanacggtcagcgtaactcgtacgttaggttacgggttacgggacggaccggtaacctacggttccgaccgggttaccgttccggacggttaccccgacgggttaaccccgacgggttcccctaccccgggtccccgttaccggtacccg

SEQ ID NO: 151008 - DNA, 620 bp, Homo sapiens
  misc_feature: GYAE6OF01B2CMB.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactcggaaccaccactgacgttgctaggttaataaatctctctctggtatacaacaactacccagacaaacgaccccaagtcatctatttatgatgtactaataacgtcgtccttcgtacgggtttacatccgtcttctcgtcgctcgacgtcgtcggccgacgacgtccctccgtcgacctctcgtcgtcggtcctaccgaggacgtaggaacgacggacggtctagtaatttacttacgtcgcgacgtactactaattaacgtacgacggtcgacgacgtacgacctacgttcggttacgggtttacgggacgggtacggaaccgtaacggccgttaccgaccggttcccgtacggtaccgaaccgtaccccggtacgtacccgtccccgtcccccgttcgtaccccg

SEQ ID NO: 151009 - DNA, 645 bp, Homo sapiens
  misc_feature: GYAE6OF01AP9AX.7.5.A05.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
tcagcgtgtctctacacgaccggtgctcgatttagatagatagacgaggggggggtctcaggaggcagcgctctcgggacgtctccaccagtggcctgggctctgctattcctcaccctcctcactcagggcacagggtcgtgggcccagtctgccctgactcagcctgcctcgtgtctgggtctcctggacagtcgatcacntctcctgcactggaaccacatgacgttgctggttataatntctctctggtatcaacactaccaggcaacgccccaagtcatctattatgatgtactataactccggtccttacgacgggtttccaacgtcgtcttctcgtcggctaccgaagttcgtggaccgtacgaccggtccctcccgtcgaccctacgttccgtacgtcgggtcctaccggacggtaccgtacggaaacggtacggtacggtaccgttaggtaactttacgttaaccgtcgtaccgtacggtcctactaacttaacgtaccgacggtacacgtacctacgtacctaacgttcgtacgggtttccgggacgggtaacggaccgtaacggtcgtaccggtaccggtaccgtacggtaccaccggtaacccgtacggaccctcccgtcccccgtgtacccg

SEQ ID NO: 151010 - DNA, 762 bp, Homo sapiens
  misc_feature: GYAE6OF01AW273.7.5.A05.1.454.CMB.1.raw
  modified_base (601)..(601): a, c, t, g, unknown or other
  misc_feature (601)..(601): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgagggcaacgaggggtcgtgggcccagtctgaccctgactcagcctgcctccgtgtctgggtctccgtaggacagtcgtatccacactcctcctgaccacgtacggaaacccaccagtacgtacggttgtcgttaaggtttaaactaaaagtctcctcctccgttaggtactacgaaactaacaacccgaacggaccaaaaccgacccctaaagtacctaactactaatttacgataattcgtaactaataacgtccgtacttcggtaacgggttactaacgttcctcttactctggtacctaccgtaacgtcgtacggacgtaaccgtcccggtaccttacccgtcgtaaaccctcgttaacccgtcgtcgggtaccctaccggtacggaccgttaagaaaccggtaacggtacggtacgttacggtaatttaacgttaacctacgtaccggtacttactactaaaccgttaanaacccggacgtacgaacgtaccgtacgtaaccgtacgtaccgggttacgggttaccgggaacgggtaccggtaaccgaacggtaaccgtaccggtacccgtacggtaaccggaccgaaccggtaacccggtaacgtccgtaccccggtcccgtacggtacc

SEQ ID NO: 151011 - DNA, 668 bp, Homo sapiens
  misc_feature: GYAE6OF01DG48R.7.5.A05.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (496)..(496): a, c, t, g, unknown or other
  misc_feature (496)..(496): n is a, c, g, or t
tcagcgtgtctctacacgaccggtgctcgatttagatagatagacgagggggggtctcaggaggcagcgctctcgggacgtctccaccatggcctggctctgctattcctcaccctcctcactcaggcacgagggtcgtggcccagtctcgccctgactcagcctgcctcgtgtcgtggtctccgtggacagtcgatcacctatcctctgacacgtacggaacccnccacgtggtacgttntacgttaggttaaactaaatctcgttctccgttagtactacaaacaacctaccgaagaccaaaccgacccaaatcatacttaatttacgagtatgttactaataacgttccggtccttacggtacggttaccctaagttcctcttcttcgtaccgtactaccgtaagtcgtacggtaccgaaccgtccgtccccgttaccctagtaaccctcgttcgtccgtcggtcctaccgtacgtacgacgtaacgtacggngtaacgtagttaacttacgttactacgtacacgtactacgtaataccgtacgacgacgtacgcgtaccgtacgtacgtacggtacggtttacggaccgggacgtacgaacgtcgtaccgtaccggtccgtacggtacaccggtaccacgtccgtcccgtcccgtcgtacccg

SEQ ID NO: 151012 - DNA, 741 bp, Homo sapiens
  misc_feature: GYAE6OF01BMXJ8.7.5.A05.1.454.CMB.1.raw
  modified_base (570)..(570): a, c, t, g, unknown or other
  misc_feature (570)..(570): n is a, c, g, or t
tcagcgtgtctctacacgaccggtgctcgatttagatagatagacgaggggggggtctcaggaggcagcgctcgtcgggacgtctccaccatggcctgggctctgctacttcctcaccctcctcactcgagggcacgagggtcgtcgggcccagtctcgccctgacctcacgcctcgccttccgtgttcgtcgggtcctccgtaggactacgtcgatccaacctattcctcctgacctaacgtacggaaaccctacctacgttcgtaccgttgaccgttaagttaaataaacttcttcctccttcgtagtaactaaccaaactaacgtaacccgaacggaacctaaaccgaccccctaaagtacctaacttactagtttatacgtacttactaacgttaagtaccgtccggttaccgtttaccggtaacgggtttaccaacgttccgttcttaccgtcgtccgtctaccgtagtcgcgaccgaccgtaccgtccctaccgtactaccgtctcgtcgtcggtcctacgacgtcgtaacggaagtacggagtactagttacttacgttacgngacgtactactactaacgtacgtaacgacgtacgaacgtaccgtacgtccgttacgttacggttaccggggttaccggaacgggtacggtaaccgtacggtccgtaccgaccggttacgtacggtaaccgacccgaccggtacgtccccgtcccggtcccgttaccgtccg

SEQ ID NO: 151013 - DNA, 643 bp, Homo sapiens
  misc_feature: GYAE6OF01A5GGN.7.5.A05.1.454.CMB.1.raw
  modified_base (425)..(425): a, c, t, g, unknown or other
  misc_feature (425)..(425): n is a, c, g, or t
  modified_base (489)..(489): a, c, t, g, unknown or other
  misc_feature (489)..(489): n is a, c, g, or t
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtggcccagtctgccctgactcagcctgcctcgtgtctgggtctcctggacagtcgatcgacatcctctgcacgtacggaacccactagtgtaccgttgcgttaggtttaaataaattctctcttccgtaggtactacaaactaagtacccgaggacaaacgaccccaaagtcactacgtatttatagtaattgtactaattacgtcggttcctacgtacgggttaccaagttccgtcttacgtcgtcgtactacgagtcgtacggcgaccgtaccggacccttccncgacctactccgttcggtcggtctaccgaggtctaggacgtagcggtactagtacttagttacngactcgcttaacgtatacgtacgagtccgacgtcacgtactacgttaggttacgggttacggaccgggaacgtaccgagtaccgtccgggtaacctcggtacggtccgacccggtaaaccggtcgacccgtcccgttcccgtacggttaccccg

SEQ ID NO: 151014 - DNA, 724 bp, Homo sapiens
  misc_feature: GYAE6OF01AV0TH.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcgagggcacgaggggtcgtgggcccagtctgccctgactcagcctgcctcgtgtctgggtctccgtggacagtcgatcaccatctcctgcactcggaacccacctacgtgtacgttgcgttggttaataaatctctctcctggtactacaacaatacccaggacaaacaccccaaagtcatctatttatgatgtctaataatcgtccttcgacgggtttcaactcgtccttctcgtcggtcctaccgtaacgtcgtgggaccgaccgtaccgggtacccttccccgtacgtaccctacttccgttaccggtcgggacccttccgacgggtaccgtaggaaacgggtacggacggtccgttaggttaacttttaaccgttacgttacggtactaacgtaccgttacgtaacttaacgtaccgtaacgggaccgacggtaacgaccgttaacctaccggttacgttaacccggggtttcggggaacccgggtacggggaaaccgtacggccgttaccggaccccggttaccggttaccggtacccaccgggtaaccccggtaccggacccgttccccggtaccccccgttcgggttaccccg

SEQ ID NO: 151015 - DNA, 813 bp, Homo sapiens
  misc_feature: GYAE6OF01DSRWE.7.5.A05.1.454.CMB.1.raw
tcagcgtgtctctacacgaccggtgctcgatttagatagatagacgagggggggggtctcaggaggcagcgctctcgggactctccaccatggcctgggctctgctattcctcaccctcctcactcagggcacagggtcgtgggcccagtctgccctgactcagcctgcctcgtgtctgggtctctggacagtcgatcaccagtcctcctgccacgttcgggaaacccaccaacgttggaaccgtttgaccgttaggtttaaataaacttatccttccttaccgttaggtaactaccaaaacctaaccgttaacccgacggaactaaaacccggaacccccaaacgttcctaattcctaattttagtacgtaagttacgtacttaacttaaacgtccggtaccttttacggtaacggggttttcccaaagttccgtccgtttacgttcgtacgggtacccttaccgtaacgttccgtacgggaccggaacccgtaaccccggtccccttacccgtaccggaaccctacgtttcccgtacggtccgggttaccgtcccggtaacggtaccggttaacggaaacgggtaacgggtaacggtacggttagttaacgttttaacgttacggttacgtacgtacgtaccgttaactaacgttaacgtaacgaacgggtactaccgacgtacggaccgtacggttacggttacggggtttaccgggacgggtaaccggaacgtaccggtacgtacggtacccggtacgtaccggtaccgaccgaccggtaacgtccgtccccgtcccgtcgttaacccg

SEQ ID NO: 151016 - DNA, 639 bp, Homo sapiens
  misc_feature: GYAE6OF01ALIAX.7.5.A05.1.454.CMB.1.raw
  modified_base (250)..(250): a, c, t, g, unknown or other
  misc_feature (250)..(250): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcacatcctcctgcacgtggaacccaccactgacgttgcttggttaataaatntctctcctggtaatcaacaataccaggcaaacgcccccaaagtcatcatttatgatgtctaatactcgtccttcgacgggtttccaatcgcttctctggctccgaagtcgtcggcgacacgtccctccctcgacctatcctcgtgggccttcgacgggtctagaaacggtacggaggtaccttagtaattttaacgttaactcggctacgtcctactaataacgttacgaacgggtccagtacgacgtactaccgttcggtacggtttaccgggcgggtaacgggaaccgacggtaccgtacggtaaccccggttccgtaaccgggttccgaacccggtaccccgtaaacgggtccccgtacccggtaccccccgttcgggtaaccccg

SEQ ID NO: 151017 - DNA, 686 bp, Homo sapiens
  misc_feature: GYAE6OF01CRFPC.7.5.A05.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacgagggtcgtggcccagtctgccctgactcagcctgcctcgtgtctggtctctggacngtcgatcacntctctgcactcggaaccaccgactgacgttgacttaggtaataaatctctctccgtagtactacaaactaactacccgagaccaaacgccccaaagtcatctatttangtatgtactatacgtcgtcttagtacggttacaagtccgtcttcgtcgtggtctacgaacgtcgtacggccgtacgaccggtcctaccgtagaccctaagtctcgtcggctccgaggctagaacgacgagtctagtacttattcagctacgactacgtaataacgtaacgtacggacgtaacgaccgtaaccgtctaaccggtttacgggttaacggggtttaccggggaacggggtaaaccgggtaacccgtaacggtacccggttaccgggaacccggtttaccggttaaaccggtaccgggtaaaccccggtacccggttaaaacgggtccccggttacccccgttaccccccgggtaccggtttaacccccg

SEQ ID NO: 151018 - DNA, 720 bp, Homo sapiens
  misc_feature: GYAE6OF01CCBUL.7.5.A05.1.454.CMB.1.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagcgtgtctctacacgaccggtgctcgatttagatagatagacgaggggggggtctcaggaggcagcgctcgtcgggacgtctccaccatggcctgggctctgctattcctccaccctcctcactcgagggcacgagggtcgtcgggcccagtctcgccctgactcagcctgcctccgtgtcgtgggtcctccgtaggacngtcgactccacctactcctccgtcgaccaccgtacggaaaccctacctacgtcggtaccgttgtacgttaggttaaataagttactcttcctcgttagtaactaaccaaaacgtaaccgtaccggaacggaaccaaaaccccgacccctaaagtccaattacgtaatttangtactntactaagtacgtccgtccgtttacggtacggtttactaacgtccgttctttccgtacgttcgtacctaccgtagtcgcggaacnccgtaccgtcctacccgtacacctagtccgttcnccgggtactcccggtagacgtaggaacggtacggtacgttactaagttacttaactttcgacgacctacgccgttactaagttacgacggaacggaccgtaccgtagacctaaccgttaggttccgggtttacgggtaccggcggaaccgtacggtacgccgtacggtaccgttccgacggtaccaccggccgtaacgcccggtcccctccgtaacggtccg

SEQ ID NO: 151019 - DNA, 693 bp, Homo sapiens
  misc_feature: GYAE6OF01EDSCX.7.5.A05.1.454.CMB.1.raw
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (339)..(339): a, c, t, g, unknown or other
  misc_feature (339)..(339): n is a, c, g, or t
  modified_base (410)..(410): a, c, t, g, unknown or other
  misc_feature (410)..(410): n is a, c, g, or t
  modified_base (537)..(537): a, c, t, g, unknown or other
  misc_feature (537)..(537): n is a, c, g, or t
tcagcgtgtctctacacgaccggtgctcgatttagatagatagacgagggggggggtctcaggaggcagcgctcgtcgggacgtctccaccatggcctgggctctgctattcctccaccctcctcactcgaggcacgagggtcggtcgggccctagtctcgcctagctcagcctgcctcgtgtcgtggtcctccgtaggacagtcatccaactntcctcgngctactacggaaccacctagtagtcgttgcgttaagttaaataagttctcgtcctagtacgtactaacaacgtaacctaccgacgacaaaccgtaccctaagtatacgtatatttagngtatcgttactaagtacgtccgttacgtaggtacggtaccctatccgtctttacgcgtagtaccctacggngtacgccggtaccaccgaccggtcccctacggtacacctacgtccggttacgtccgggtaacctccggtaacggtcaacgggtaaacccggtagtacggtacgttagttaactttaactaggtaccngtaccctactagtaacacgtagacgtacacggttaccaaggttacgtccggttacgggtacgggttacgggaccggaacgtaacgggcgtccggtacggtaacgtccgacggtacaccggtacccgtagtccccggttacccgcggtccctacccg

SEQ ID NO: 151020 - DNA, 788 bp, Homo sapiens
  misc_feature: GYAE6OF01EALGS.7.5.A05.1.454.CMB.1.raw
  modified_base (198)..(198): a, c, t, g, unknown or other
  misc_feature (198)..(198): n is a, c, g, or t
  modified_base (618)..(618): a, c, t, g, unknown or other
  misc_feature (618)..(618): n is a, c, g, or t
tcagcgtgtctctacacgaccggtgctcgatttagatagatagacgagggggggggtctcaggaggcagcgctctcgggacgtctccaccatggcctgggctctgctattcctcacccctcctcactcgagggcacgagggtcggtgggcccagtctgccctgactcagcctgcctcgtgtcgtgggtctcctggacngtcgatcaccatctcctgccacgtacggaacccaccacgtgtacgttgcgttagttaataatatcctctccgtagtactacaacaacgtaccaacggaaccaaccgaccccaagtactactacgttaatttatagtagttcgtacttaagtaacgtccggttccgtttacggttacgggtttacctaacgttccgttccttaccgtccgttcggtccttaccgtacggttccgtacggaccggtaacccgtcccggtcccctcccgttaccgaacccttcttccggttccggtccgggtccttacccgggaagggtacgtaacgggaaaccggacgggtaaggtccgtttaacgttaagtttaacccgtttactcggaccgttaagtcctaacgttacgttaaacgtcgaacgggtaacnccggcgttaaccgtacggtaccggtttacgggtttaaccgggggttaccgggaaccggggtaaacccggacgtaccggtcccgtacgggttacccccgttcggtaacccgggtcaacccggtacccgggtaacgtacccccgttcccccggttcccgtccgttaaccccg

SEQ ID NO: 151021 - DNA, 701 bp, Homo sapiens
  misc_feature: GYAE6OF01CHCNV.7.5.A05.1.454.CMB.1.raw
tcagcgtgtctctacacgaccggtgctcgatttagatagatagacgagggggggggtctcagggaggcagcgctctcgggacgtctccaccatggcctgggctctgctattcctcaccctcctcactcagggcacgaggggtcgtgggcccagtctcgccctgactcagcctgcctcgtgtcgtgggtctccgtggacagtcgatcaccatcctcctgcactcggaacccacctactcgacgttgcttaggttaataatctctctcctggtactacaacaactacccaggacaaacgccccaaagtcatctaatttatgattgtacttaataagtccggtcctttacgtacggggtttaccaacgttcgtctttcgtcgtacggtccttacccgtaagttcgtcgggaccggtacctaaccgggtccccttacccgtacggacctacgttccgttcgtacgggtcctaccgacggacgttacgggaacgacggacggtactaggttactttaacttacggactcgtacgtaccttcgaattaacgtcgaacgtcgacgtaccgagtacctccggttacgtacgggtttacgggacgggtaccggtaccggtaacgtacggtaccggttacccggttcggtacgggtaccgaccggtaacccggacggtacccgtccccgtccccggttcgggttaaccccc

SEQ ID NO: 151022 - DNA, 622 bp, Homo sapiens
  misc_feature: GYAE6OF01BP14B.7.5.A05.1.454.CMB.1.raw
  modified_base (202)..(202): a, c, t, g, unknown or other
  misc_feature (202)..(202): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacntctctgcactcggaaccacactgacgttgcttggttaataatctctctctgtactacaacactacccgagaccaacgccccaaagtcatctatttatgtatgtactaagtactcggtccttcggtacgggtttaccaagtcgtcttcgtcgtcggtcctaccgtaacgtcgtacgggaccgtaccgacccggtccctcccgtacgaccctacttccgtcgtcgggtcctaccgaggtctaggaacggacggtacgtacgtagtactttacgttacgtcgtactagtcctactaattaacgacgtacggacgacgtacgacgtctacgtcggttacgggttcgggacgggacggaccgagccgtacggaccgtccgttacggcgaccggaccgacggtccctcccgtccccgtcggtaccc

SEQ ID NO: 151023 - DNA, 806 bp, Homo sapiens
  misc_feature: GYAE6OF01DQAHR.7.5.A05.1.454.CMB.1.raw
tcagcgtgtctctacacgaccggtgctcgatttagatagatagacgaggggggggtctcaggaggcatcgctctcgggacgtctccaccatggcctgggctctgctattcctcaccctcctcactcagggcagtagggtcgtgggcccagtctgccctgactcagcctgcctcgtgtctgggtctcctggacagtcaatcaccatcctcctgccactacggaacccaccacttggacgttgcgttaggttaataaattctcttactccgttaggtactacaaacaaacgtacccaaggaccaaaccgaccccaaagtcatactatttatgatgtactaataacgtccggtacttcgtacgggttaccaacttcgtcttacgtctggtcctaccgtaacgtcgtcggtaccgaccgtacccggtccccttacccgtacgtacctaccttcgtaccgtccgggtccctacccggtaacgggtcgtaacggaaacgggaacggtacggtacgtacggttactttaacgtttaacgcgtacgtaccgtcctaacgttaagttaacgtaacccgaacgggtaccgaaaggtcccgtaacggtacccttaacccgggttaccgggtttaaccggggggttttacccggggaaccgggggtaaaccggggtaaacccgtaaaccggggttacccggttaacccgggttaacccccggttaccgggttaaaccccgggtacgtaaaccccgggaccccggtaaaccgggttcccccggtaccccggttccccccgggttacccggttaaccccg

SEQ ID NO: 151024 - DNA, 691 bp, Homo sapiens
  misc_feature: GYAE6OF01BJ4SW.7.5.A05.1.454.CMB.1.raw
  modified_base (277)..(277): a, c, t, g, unknown or other
  misc_feature (277)..(277): n is a, c, g, or t
  modified_base (326)..(326): a, c, t, g, unknown or other
  misc_feature (326)..(326): n is a, c, g, or t
tcagcgtgtctctacacgaccggtgctcgatttagatagatagacagggggggggtctcagggaggcagcgctctcgggacgtctccaccagtggcctgggctctgctattcctcaccctcctcactcagggcacgaggggtcgtgggcccagtctgccctgacctcagcctgcctccgtgtcgtgggtctccgtggacagtcgatcacctatctcctgcacgtcggaacccactacgtgacgttgcgttagttaataaatactctctccgtagtanacaaacaactacccatcgaaccaaaccgacccctaaagtcatctattangtatgtactatagtccgtcttacggtacggttacaatccgtacttctgtcgctacgtagtccgcggccgaccgtaccggtccccttaccgtacggacctacgttcccgtaccggtccggtacctccggtacgggtactaaccgggaaacggtaccggtacgggctttaaggtaacttttacgttaacgtacgcccgtatcctaacgtaactaacgttaacggacgtaccacggcgaacgtcccgtacggtttaccggtacggggtttaccggggacgggaaaccgtaccggtaacgggtcctacggtaccccgttacggtaacgcccggacggtcccggacgtccggtacccgtccccgtaccgg

SEQ ID NO: 151025 - DNA, 696 bp, Homo sapiens
  misc_feature: GYAE6OF01BU2O5.7.5.A05.1.454.CMB.1.raw
  modified_base (313)..(313): a, c, t, g, unknown or other
  misc_feature (313)..(313): n is a, c, g, or t
  modified_base (405)..(405): a, c, t, g, unknown or other
  misc_feature (405)..(405): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacctatctcctgccactcggaaacccaccgactcgacgttgcgttggttaataaatctctctcctgtatcaacactacccaggacaaacgcccccaaagtcaactctatttangtatgtactaattaacgtccggtccttacggtacgggtttaccaattcgtctttctcgtcggtacctaccgtaacgtcgtacggccgtaacnccgggtcctcccgtacgaccacttccgtacgtcgggtacctccgtacggacgttacggaaacggtacgacggtctacggttaactttagtttacgtcgacgtagtcctataacgttacgtaacgacgtacgaagtaccgagtcccctaaggttaccgttggggttttaaccggggaccgggtaaacgggtacccgtaacggtccgttaaccggtacccgtacccgggttacgtacccggaaccggtaccccgtacgggtaccctcccccgtccccccggtgggttaccccc

SEQ ID NO: 151026 - DNA, 763 bp, Homo sapiens
  misc_feature: GYAE6OF01CWLM5.7.5.A05.1.454.CMB.1.raw
tcagcgtgtctctacacgaccggtgctcgatttagatagatagacgaggggggggtctcagggaggcagcgctcgtcgggacgtctccaccatggcctgggctctgctattcctcaccctcctcactcgagggcacaggggtcgtcgggcccagtctgccctgactcagcctgccctccgtgtcgtgggtcctaccgtggacagtcgaatccaccatcctcctgccaccgtacggaacccacacgtgtacgttgctaggtttaaataactattcgtaccttctacggtataccaaactaactacccgagaaccaaaccgtcccccaaagtcctatactattatgtatcgtataagtacgtcgtacttacggtacggttacagttcgacttcctgtccgacttaccgagtcgcggaccgtaccgaccccgtacctacccgtactacgttacctcgttcgccgggtacctacccgtaagggtacctagggaaacggacggtaacggttaccgtaaggttaactttagttacgtacggtacctaacttcccgtaaagttacgtaactaccggaacggacccgttaagaccctacgggttacctaacccgggtttacgggtttaccgggggtaaccccgggttagggaaacccgggtaacctacggttaccccggtaacggttacccgttaaacggttaacccggacccgaccgggttaacccacccggggttaccccgtaccccggccccgtttccggtaaccccg

SEQ ID NO: 151027 - DNA, 756 bp, Homo sapiens
  misc_feature: GYAE6OF01DF99O.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcgagggcacagggtcgtgggcccagtctcgccctgactcagcctgcctccgtgtcgtgggtctccgtggacagtcgatcaccatctctagccacgtggaacccacactgtacgttgacttaggtaataattactctctccgtagtactacaaacaactacccaaggaaccaaaccgaccccaaatcaacttacctaattttagagtacgtacggtacttaagtaacgtccgggttacctttacgggtaacgggtttacctaaacgttccttaccgtttcgtcgtacggtacctaccgtaaggtccgttacggaccggaaccgtaccggtcccttaccccgagtaccctacttccgtcggtaccggtacctccgaacgtacgtaacggaacgtaacggtagtacttaggtaatttacgttacgtcgtacgtacgtactacgtaacttaacgaacgtacggaccgtaacggacgacgtaccgtacgttaccggttaacggggtttccggggaacggtaacgggaaccggtacggtaaccgtaccgggttaacccggttacccgtaacgggtacccgaaaccgggacccgtaacgggtccccgttacccggtcccccgttccggttaaccccgg

SEQ ID NO: 151028 - DNA, 677 bp, Homo sapiens
  misc_feature: GYAE6OF01C15XB.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcacatctcctgcactcgaaccaccactgacgttgctagttaataaatctctctcctgtatcaacaatacccagcaaacgaccccaagtcatctattangtatagtactataagtcgctttcgaggtttccaatcgtacttcgtctacgtctaccgaagtcgtgccgacgtaccgtccctacctcgacctactcgtcgtcggtacctcgtaacggtctacggtaacggacggtaggtaccgttagtacttttaacgttaacgtccgtacgtacggttaccttacgaacttaacgtaaccgacgggtaccaacgggtacctacgtaccgtaacggttcgttaacggggttttaccggacggggtaaaccgggaccgtaacggtccgttaacggtaccccggttaacggtacccgggtaccgtaaccggtacccgtaaaccgggtcccttaccccggtcccccgttaccggttacccccgg

SEQ ID NO: 151029 - DNA, 783 bp, Homo sapiens
  misc_feature: GYAE6OF01DR3K5.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacgaggggggggtctcaggaggcagcgctctcgggactctccaccatcggcctgggctctgctacttcctccaccctcctcactcgaggcacgagggtcgtcgggccagtctcgccctgacctcacgcctcgcctcgtgtcgtggtcctacgngacagtcgataccacacttcctcgtcgaccgtacgtaccggaacccacgtacgttcggtacgttcgtacgtttagttaaaataaactttctccgttaccttacgttacgtaactaacctaaaccaaccgtaacccgaacgaaaccaaccccgtaacccgtaactacctattacttaatttacgtagtacttacgtaacttaacgttaccgtccgttaccgtttaggttaccggttacctacgttcgttcgtttccgtacgtaccgtaccgttaacgtaccggttcggaccggaaccgtacccgtacccggtccctaccgtaacgtaccctcgttccgttcggtacccggcgtaccggtacgtacggaacggtaacggtaacggtacggtacttaagttaccgttacgttagacgtaaccgtactaaccgtaagtacgttaccgggaagaccggacaccggtactaccgttaccgttacgggttacgggttaccgggtacggaacggtaccgacgtacggccgttaacggtaccggtcggtaccgacgtaccgtaaccggtcccgacccgtcccggtaccgtcgtacc

SEQ ID NO: 151030 - DNA, 710 bp, Homo sapiens
  misc_feature: GYAE6OF01CB52P.7.5.A05.1.454.CMB.1.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
tcagcgtgtctctacacgaccggtgctcgatttagatagatagacgaggggggggtctcagggaggcagcgctctcgggacgtctccaccatggcctgggctctgctattcctccaccctcctcactcatggcacgagggtcgtcgggcccagtctcgccctgactcacgcctgccctcgtgtcgtggtctccgtggactgtcgactccacctatcctcgtgaccacgtacgaacccacctacgtgtacgttgtcgtagttaataaactntctctccgtgtacacaacaactaccgagaccaacgacccgtaaatctactatattangtacttgtactatacgtccgtccttacggtacggttactaacgttcgtcttcgtcgtcgtacctacgtaagtcgtacggccgacgaccgtcctcccgtactaccgacttccgtacggttccggaacgtccggtaacggacgtaacggaaacggtaccggagtacgttagttaacttacgttacgtacggtactacggtacctaacttaagtaaacgtacgacggtacgtacgacgtacgacgttacggttaccgggtacgggttccgggaacggggaaccggtaaccgtaaccggtccggttaaccggttcccggtaccgtaaccggtaccgtacccgggaacccgtaacccggtcccggttaccccgtccccggttaacccg

SEQ ID NO: 151031 - DNA, 623 bp, Homo sapiens
  misc_feature: GYAE6OF01AO54D.7.5.A05.1.454.CMB.1.raw
  modified_base (250)..(250): a, c, t, g, unknown or other
  misc_feature (250)..(250): n is a, c, g, or t
  modified_base (363)..(363): a, c, t, g, unknown or other
  misc_feature (363)..(363): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttgctggttaataaatntctctcctggtatacaacaatacccaggacaaacgccccaaagtcatctattatgatcgtctaataactcggccttcgacgggtttccaatcgtcttctcgtcgctcaagtcncggcgacgaccggtcctccctcgacctatccgtcgtcgggctccgaggtctagaacggacgtaggtcttagtatttacttacgtgtcgacgtctacgtactaatacggacggtacaagtaccgagtcctaaccgttacggttacgggtttccggggagggtaccgggaaccgtacggtccgtacggtacccgtacccggttacggttaccgaccggtaccccgtaacgggccccttcccggtcccccgttcggggtaccc

SEQ ID NO: 151032 - DNA, 584 bp, Homo sapiens
  misc_feature: GYAE6OF01E5CU5.7.5.A05.1.454.CMB.1.raw
  modified_base (233)..(233): a, c, t, g, unknown or other
  misc_feature (233)..(233): n is a, c, g, or t
  modified_base (347)..(347): a, c, t, g, unknown or other
  misc_feature (347)..(347): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttnctaggttataaatatctctcctggtatcaacaatacccaggacaaacgcccccaaagtcatctatttactgtatgtactataactcgtccttgtacgggtttccaatcgcttcnctcggctcaacgtctggcacacggcctcctgacctatcctcgtcggctcgagtctaggaagcgagtctagtattacgttacncgactgtacctntattacacgtacggacgngtaccagtccctaacgtacggttacgggtttcggaccgggtaaccggacgtacgtcgtccggaccgtccggttacggtacacccggtaccgaacggtccgtccccggtcccccgtcgttacccgg

SEQ ID NO: 151033 - DNA, 595 bp, Homo sapiens
  misc_feature: GYAE6OF01D53ZT.7.5.A05.1.454.CMB.1.raw
  modified_base (242)..(242): a, c, t, g, unknown or other
  misc_feature (242)..(242): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctcgtgtctgggtctctggacagtcgatcaccatcctctgcactggaaccacatgacgttgctggttaataatntctactctggtatcaacaatacccagcaaacgccccaaagtcatacatttatgatgtactataactcggtcctttcgtacggggtttccaaagttccgtacttcgtctggtctacctaaggtctaggacgtacaaccggtcctccctgtaccacttctcgtacgggcctccgacggtcgtaggaacgacggacggtcgtagtacgtttacttacgtcgctagtcctacgacttaagtacacggtcgaagtcacggtctacgttcgtacggtttcgggacggtacgggaccaacggtctacggtaccgtccgtacggtcgacgtccgaacggtcgtccgcccgtcgggtacccg

SEQ ID NO: 151034 - DNA, 752 bp, Homo sapiens
  misc_feature: GYAE6OF01B1B64.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcaggcacgagggtcgtgggcccagtctgccctgactcagcctgccctcgtgtcgtggtctcctaggacagtcgatccaccactcctcctgccacgtacgaaccaccgtactcgaccgttgcgttaggttaataaattcgtactctcctagtactcaacacgtaccaggacaaccgaccctaagtcatactatttagctagttgtactaataacgtccggtccttacggtacgggtttaccaacgttgtccttcgtcgtcgtactactaacgtcgtcggacgtaccgaccgcccctccgtcgacctagtccgttccgtaccggtcgtaccgacgggttaccgaggtaaaccggtacggacgggttactagtttaagtttaacgttaaccggtctaccgtaacggtaccttaacgtaactttaacgaaccgtacggtaaccaagggaccgtacgtacccgttaccggtttaccgggttaaccgggtttaccgggaccgggtaacgggtaaacccggttaccggtacccggtaacggttaccccggtacccgggtaactaaacccggtacccgggaaaacccttcgggccccgtttaaaccccgggtcccccgttaccggtaaccccccg

SEQ ID NO: 151035 - DNA, 760 bp, Homo sapiens
  misc_feature: GYAE6OF01DO438.7.5.A05.1.454.CMB.1.raw
  modified_base (583)..(583): a, c, t, g, unknown or other
  misc_feature (583)..(583): n is a, c, g, or t
tcagcgtgtctctacacgaccggtgctcgatttagatagatagacgaggggggggtctcaggaggcagcgctcgtcggggacgtctccaccatggcctgggctctgctattcctcaccctcctcactcagggcacgaggggtcgtcgggcccagtctcgccctgacctcacgcctgcctcgtgtcgtggtctccgtaggacagtcgactcacctactcctccgtgaccacgtaccggaaccctaccactcggtacgttcgtacgttaggttaaattaactacgtccttccgtccgttgtactaaccaactaactacccgaaggaccaaaccgacccccaaatacctatacttattactgtactgtactaatacgtcggtcttacggtacggttaccatccgtcttcgtcgtcgtacctacgtacgtcgtacggaccgaccgtacccgcccctacccggtacctaccttcgtccgttcggtacgcccgtacgaccgggtcgtaaacggacggtaacgggtacgtacgttacggttaactttacggttaccacggtaccgtaccgtacgtaactaacgttaacgnggaaccggtaccgagaaccgtcgtaaccgtacgggttccgggtttacgggtttccgggggaacggtaaacccggaccgaaccgggtccgtaccgggttaccccgtacggtaccggtaccccgtaacggaccccggttaacggcccccgttaccccggtcccccgttcccgggtaccc

SEQ ID NO: 151036 - DNA, 701 bp, Homo sapiens
  misc_feature: GYAE6OF01A9TBY.7.5.A05.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacgaggggggggtctcaggaggcagcgctctcgggacgtctccaccatggcctgggctctgctattcctcacccctcctcactcagggcacagggtcgtgggcccagtctgccctgactcagcctgcctccgtgtctgggtctccgtggacagtcgatccaccatctctgcactcggaaccaccactgtacgtgctaggttaanaaatntctctctgtatcaacactaccagcaaacgcccccaaagtcatcatttatgtatcgttactataacgtccggtaccgtttcgtaacggggtttaccaacgttcgtccgttccttcgtcggtcttaccgaacggtcgtttcggaccgaccgtaccggtccctcccgtacggaccctaacgttccttcgtcgggtcccttacccgtacggacgttacggaaacggtaaccgaggtcgtagttacgtttaacgttaacgttacgacctaggtcctaactaactactaaccgacggacgtaacgacgtaacgccgtaacgttaccggttacggggtttacggggaccgggtaacggggaccctaacggtacgttacccggtacccggttaccggtcgtacccgaacgggtacccgacggtaacccgtccccggtccccccggttaggttccccg

SEQ ID NO: 151037 - DNA, 710 bp, Homo sapiens
  misc_feature: GYAE6OF01CF4NL.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcgtggacagtcgatcaccatcctcctgcactacggaacccaccactcgacgttgcgttaggtaataatactctctctgtactacaacaactaccaggacaaacgaccccaagtcatactattatgatcgtactatactcggtcttacgtacgggttaccacgttcgtcttcgtcgtcggactaccgacgtgtcggcgtaccgccgccctcctacgacctactcgtcgtccgggtccctaccgacggtaccgtacggaaggtacccggaggtccgttagttaacgtttacgttaacgttccgacgtaccgtaccttacgtaaacgttaacgtacggaacgggtaccgaaccgtaccgtaacgtacccgttaacccgtttacgggttaaccggggtttccggggaaccggggtaccgggaaacccgtacgggtacccgtaccgggtacccggttacccggtacggtacccgtaccgggaacccctaccggggacccctaccccggttcccccgggtccgttacccgg

SEQ ID NO: 151038 - DNA, 667 bp, Homo sapiens
  misc_feature: GYAE6OF01ETCV1.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcaccatctcctgcactcggaacccaccactgacgttgcgttaggttaataaatntctctcgtgtatacaacaactaccagacaaacgaccccaatcatctatttatagtatgtactaatacgtccggtccttacggtacgggtttacctaacgttcgtcttccgtcgtcggtcctactagtcgtacggaccgaccgacccggtcccctcccgtacgaccctacttccgtccgtcgggtccgtaccgacggtacgtacggaaacggacggacggtacgttagttaacttttagttaccgtacgtcgtacgtcttaactataacgtacgaaggaccacgacacgtacctacgttacgggttacgggttccgggaccgggtaaccggaaccgtacggtccgtacggtacccggtccgtacggcgaacccgacccgtaacggtccccgtcccggtccccggtccgtacccg

SEQ ID NO: 151039 - DNA, 725 bp, Homo sapiens
  misc_feature: GYAE6OF01BIIJX.7.5.A05.1.454.CMB.1.raw
  modified_base (349)..(349): a, c, t, g, unknown or other
  misc_feature (349)..(349): n is a, c, g, or t
tcagcgtgtctctacacgaccggtgctcgatttagatagatagacgagggggggtctcaggaggcagcgctctcgggacgtctccaccatggcctgggctctgctattcctcaccctccgtcactcagggcacagggtcgtgggcccagtctgaccctgactcagcctgcctcgtgtctgggtcctccgtggacagtcgactccacctatcctacctgccacgtcggaacccaccgactgaaccgtttgccgttaggttaataaactactcctctacgtagtactaacgtaacaaccgtaccgagaaccaaacccgaccccgtaaagtacacgtaacttacttaacgtntatcgttactaacgttacgttccggtaccgttcgggttaaccggtttaccaaacgttccgttacgttccgttacggtccgttaccgtaccggtaacggttcgtccgggtaccgtaccggtaccccgttccccgtacctacgaacccttccgttctcgggtaccgtcccgttaaccggcggtacgtaacggaacggtaacgtcgggtactacgttacgttaactacgtcgtacctgtaccctaggtactaacgtcggactacgactcgtaactctaacggtgggttacggtcgggacgaccggaacgtggtacgttacccgcggttaccgtacgcccgtacgtaccgtaccggcccctccggttcccgacgttcccc

SEQ ID NO: 151040 - DNA, 763 bp, Homo sapiens
  misc_feature: GYAE6OF01BAXB1.7.5.A05.1.454.CMB.1.raw
  modified_base (549)..(549): a, c, t, g, unknown or other
  misc_feature (549)..(549): n is a, c, g, or t
  modified_base (560)..(560): a, c, t, g, unknown or other
  misc_feature (560)..(560): n is a, c, g, or t
tcagcgtgtctctacacgaccggtgctcgatttagatagatagacgagggggggggtctcgaggaggcagcgctcgtcgggacgtctccaccatggcctgggctctgctattcctcaccctctcactcagggcacagggtcgtgggcccagtctgccctgactcgagcctgcctcgtgtctgggtctccgtggacaggtcatccgacctatccgtcctgacacgtcggaacccacgtacgtggaccgttgcgttaggttaaataaatctccttctaccgtaggtactacaaactaactaccgaaggaccaaaccgaccccgaaatctatactatttatgtacttcgtactaatacgtccgtaccgttacggttaacggggtttaccaacgttccgttacttcttcgtcggcctacgaacgttcggtacggaccggaccgacccggtccctaccgtcgtaacctacgtccgttcggtacggtcctaaccggtacgtacggtaacgaacgggacggtacggtaccgtagttaactttacggtacttacggntacggtactanaacttacgaagtacgacgacgttacgaccgttactacggttacgggttaccgggtttacggggaacggggtaccgggaaaccgttacgggtaaccgttaccgggtaaccccgggttaccgtaccggggtaacccgaaccgggtacccccggtaacgggtaaccccgttcccccggtaacccccggtttcggttaaccccccgg

SEQ ID NO: 151041 - DNA, 608 bp, Homo sapiens
  misc_feature: GYAE6OF01BDOXM.7.5.A05.1.454.CMB.1.raw
  modified_base (203)..(203): a, c, t, g, unknown or other
  misc_feature (203)..(203): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctcgccctgactcagcctgcctcgtgtcgtgggtctctgacagtcgatcacntctctgcacgtcgaacccactactgtacgttgcttaggttaataaacttctcttctcgtgtactacaacaactaccgagacaaaccgaccccaagtcatactagtttatgtattgtactataacgtccggtccgtttggtacgggttcaacgtccgtcttcgtacgtcgtctacagttcncggaccaccgtacgccctaccgtcactactctcgtcgtctcgngcgtgagacggagtacgtgtatatacgtgctanctatacgtactaacgagacgagactacgtactacggttcgttacgggttccggggacgggtaccggtaccgaggtccgttacgggtacccgttcgaccggtacgaccgtacccggaaccgtcccggttcccgtccccggtcgttacccg

SEQ ID NO: 151042 - DNA, 632 bp, Homo sapiens
  misc_feature: GYAE6OF01BKGRS.7.5.A05.1.454.CMB.1.raw
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcacatctcctgcactggaaccctacactgacgttgcttggttaataaatntctctcctgtatcaacaataccaggacaacgccccaaagtcatctatttangatntacttataatcggtccttgagggtttaccaatcgtcttcgtctacggctcgaagtcgtcggcgaccgacggtccctcccgtagacccatcctacgtcggctccgagcgttagaacgtcgaggtctagtacttatacgtgacgtacgtactcaacttacgtacgaacgggacaacgtacgaacgtccgtaacgttaccggttacgggtttccgggacggggttaaacgggacccgaacgtccgtacggttaaccggtccgttaaccggggtacctaaccggaccccgtaacggtcccggttccccgtccccccggttcgggttacccg

SEQ ID NO: 151043 - DNA, 641 bp, Homo sapiens
  misc_feature: GYAE6OF01B60EA.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactggacgttgcttaggttaataatatctctcctgtatcaacaactaccaggacaacgaccccaaagtcatctatttatgatgtactaataacgtcggtccttcggtacgggtttaccagttcgtcttctcgtcgctccagtctcggcgacacgtccctccgtcgactatccgtcgtcgggtcctaccgacggtcgtacgaaacggacggtacggtaccgttagtatttacttacgtacgtcgaacgttctactaacgtactaacgaggaccgacgtacgaccgtactaccgttcggttacgggtttccgggacggggtaacgggtaaccgtaacgtccgtaccggacccggttaccgtacgggtaccaccggtacccgaccggtcccgttcccggtaccccccgtgggttaccccg

SEQ ID NO: 151044 - DNA, 674 bp, Homo sapiens
  misc_feature: GYAE6OF01BUMAJ.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacgagggggggggtctcaggaggcagcgctctcggggacgtctccaccatggcctgggctctgctattcctcaccctcctcactcagggcacaggggtcgtgggcccagtctgccctgactcagcctgcctccgtgtctgggtctcctggacngtcgatcaccatctcctgcactcggaaccacactgacgttgcgttgttaataatatctctcctagtatacaactaactaccaggaaccaaaccgacccccaaagtactactactaatttactagtattgtattaagttaagtccgtccgtttacggtacgggtttaccaagtcgtacttctacgtcgtctacctaacgtcgtcggacgaccgaccggtccctcccgtacgacctacgttccgtcggtcgggtcctccggtacggcgtacggaacgaccggtaggtcgtagttaactttacttacgcgtcgactctacaagtacgacgacgacgacgacacgacttacgtcggttaaccgggttcggggaaccgggtaacggaaccgtacggtaccggttaccgacccggttacggtaaccggtcccgaaccgacccgggtaccgggtacccttccccggtcccgtccccggttacccg

SEQ ID NO: 151045 - DNA, 593 bp, Homo sapiens
  misc_feature: GYAE6OF01A5PIE.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcacatctcctgcactcggaaaccaccactgacgttgcttggttaataatactctctcctggtatcaacaatacccaggacaaacgacccccaaagtccatctatttatgatgtctataatcggtccttcgtacggggtttaccaactcgtcttctctgtcctaccaagtcgtggccgtacgaccggtccctaccctcggaccctacttcctcgtcgggcctcccgaggacctgaacggacggacggctagtatttactttacgtgtaccagtctacaatactaacgacgacacggcacgcctaccgttccggtagggtttccgggacggtacgggaccaaggtccgtaccgaccgtcgtacggcacgcccacgcctccgccccgtcgtacccg

SEQ ID NO: 151046 - DNA, 164 bp, Homo sapiens
  misc_feature: GYAE6OF01CLDOG.7.5.A05.1.454.CMB.1.raw
  modified_base (149)..(164): a, c, t, g, unknown or other
  misc_feature (149)..(164): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccnnnnnnnnnnnnnnnn

SEQ ID NO: 151047 - DNA, 643 bp, Homo sapiens
  misc_feature: GYAE6OF01CGNBU.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacgaggggtcgtgggcccagtctgccctgactcagcctgcctccgtgtctgggtctcctggacagtcgatcaccatctcctgcactaggaaccacactgacgttgctaggttaataatatctctcgtagtatacaacaataccaggacaaacgcccaaagtcatactatttatgtatcgtactaataacgtcggtaccttcgtacgggtttaccaagtctcttctcgtcgctaccaagtcgtggacacgaccggtccctcctcgacctctccgtacgtcggtcctacgacggtacgtaggaacgacggtaggtcttagtatttaacgttcgtcgacgtactctataacttagaacgtagacgtacgcgtagaccttacgtacggttacggggtttccgggacgggaaccggaaccgacggttaccggtaccggtaacccggttaccggtaacggttccgaacccgaccggtaaccgggtacccgtccccggtccccgtccggtttaacccg

SEQ ID NO: 151048 - DNA, 689 bp, Homo sapiens
  misc_feature: GYAE6OF01DU381.7.5.A05.1.454.CMB.1.raw
  modified_base (250)..(250): a, c, t, g, unknown or other
  misc_feature (250)..(250): n is a, c, g, or t
  modified_base (497)..(497): a, c, t, g, unknown or other
  misc_feature (497)..(497): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctcgtgtcgtgggtctcctggacagtcgatccaccatctcctgcactacggaacccacactgacgttgctggtaataatntctctcgtgtactacaacaactaccaggacaaaccgaccccaaagtcatactattatgtatgtactaataacgtcgtccgtttcgtacgggtttaccacgtcgtcttctcgtcggtactaccgtaagttccgtacgggaccgaccgtacccggtccctccccgtacgtaccctacgttccgtaccggtcgggtccctaccggagggtactagggaacgcgtaagggtcttagtatttacgttaccgngacgtacgtctactaacgtaagtaccggaaggtcccaagggtaccctaacggacttaaccgttgggttaaccggggtttcggggaaccgggtacggggtaaccacgggtaccggtacggttacccgtacggtaacggtaccgacccgtacccggaaccggtcccgtacccccggtcccgttacggtaccccg

SEQ ID NO: 151049 - DNA, 646 bp, Homo sapiens
  misc_feature: GYAE6OF01AWJJR.7.5.A05.1.454.CMB.1.raw
  modified_base (311)..(311): a, c, t, g, unknown or other
  misc_feature (311)..(311): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactacggaaccaccactgacgttgcttaggttaataaatatctctccgtgtatacaacaactacccagacaaacgacccctaaagtcaatctatttangatgtactatacgtcgtccttacggtacggtttcattcgcttctcgtcgctctaagtcgtcggacgacgaccgtcccttacctcgaacctcttcgtcgtcgggcctaccgaggtcgtagaacggacggagtccttagtatttacgttactcgactacggtacctacgtattacgtacgacggacacggacgacgacttcgttacggttacggggtttccgggaacgggtaacgggtacccgaacggtccggtaaccggttccccggtacggtacccggtacaccccggaccgtacccgggtacccgttcccccggtcccccggttcggtaccccg

SEQ ID NO: 151050 - DNA, 768 bp, Homo sapiens
  misc_feature: GYAE6OF01A4BTU.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactcggaaccaccactgacgttgcttaggttaataaatactcctacttccgtggtaactacaaacaactacccaggacaaaccgacccccaaagtctaacttactacttttagtagtacttacgtacttaaagtaacgttccggtacccgtttacggttaacggggtttacctaaacgttccgttactttacctacggttaccggtacttacccgtaaaggttccgttacggaccgtaaccgacccggtcccttacccgtacgtaacccgtacttcgttacgtacgggtccttacccggacggtacgttaacggaacggtaaaccggtaggtaccttaggttaaactttaacgttaacgtcgtacgtaaccgtcctacgtaacttaacgtacaacggtacaaccggtctaacgacctacggttaccggtacggggtttaccgggaccgggaaacggtacccgaaaggtcccggtaacccgtacccggttaccggacggttaccaacccgggaccgtaaacggtcccgttacccccggtcccgttcccggtaacccg

SEQ ID NO: 151051 - DNA, 583 bp, Homo sapiens
  misc_feature: GYAE6OF01DVAYB.7.5.A05.1.454.CMB.1.raw
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcaccatctcctgcactggaacccaccactgacgttgcttggttaataaatatctctcctgtatcaacaactaccagacaaacgaccccaaagtcatactatttatgtatgtctatatcgtcttcgtagggttcatcgtcttctctgctcagtctgcgcacgtcctccnaccatcctctggcctcaggctaggaagcggacgtgacgttattactttcgtcgacagccttanattaacgtaacgacggctagcctacgcctaacgttccggttagggtttccggtacgggaccgggaaccgacggtaccgttacggacccgttccggttaacggccgtaacggacccggtaacgtcccgtaccccgtccccgtccgttaccccg

SEQ ID NO: 151052 - DNA, 670 bp, Homo sapiens
  misc_feature: GYAE6OF01CPJA6.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgccctgactcagcctgcctccgtgtcgtgggtctcctggacagtcgatcaccatctctgcacgtcggaaccaccactgacgttgcttggtaataattactctctctgtactacaacaactaccaggaccaaacgaccccaagtcatactatttatgtatcgtactaataactccggtacctttacggtaacgggtttacctaacgttccgtactttccgtcgttcggtacccttaccgtaacggttcgtacggaccgaccgtacccggtcccttacccgtacgtaccctacgttccgtcggtcggtccgtccggtacggtacgtacggaacggtacggtacggtacgtagttacgttacgttacgtcgtacgacgtactactaactacgaacgtacgacgacgtcgacgtctacgtcggtacgggtttcgggacggtacggaccgacggtccgtacgtaccggtcggtaccgtacgaccggtaccgtacggtcccgtcccggtccccgtcgtacccg

SEQ ID NO: 151053 - DNA, 689 bp, Homo sapiens
  misc_feature: GYAE6OF01EK9WF.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctcgtgtctgggtctccgtggacagtcgatcaccatctctgcactcggaaccaccactcgacgttgcgttaggttaataaatactctctcctagtatcaaacactaccgagaccaaacgaccccaaagtcactatatttatgattgtactattaactccggtccgtttacgtacggggtttacctaagttccgtcctttaccgtcgtacggtcctacccgtaaggttccgtacggtaccgtaccgtacccgggtcccttcccgtacgtacccgtacttccgtcggtcggtcccgttacccgaagggtccgttaacgggaaacggaaccgggaacggttcgtacgttaatttaacgttactcggaactaggtcctacgtataacgtaacgtaggacctacgtcacggtacctaacgttacggttacggttcggggaccggtacgggaacctacggtcgtaacctccgggtacctacggtacgacccgtaccggaccgtactccccggtcccgtcggtaccc

SEQ ID NO: 151054 - DNA, 611 bp, Homo sapiens
  misc_feature: GYAE6OF01A63OH.7.5.A05.1.454.CMB.1.raw
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgccttcagggtttccatcgcttctctgctcaagtctggcgacacggccctcccgtgacccatctcgtcgggtcctccgaggtctaggaagaccggaggccttggtaatttattacctgacngctnaattactacgaggtacaggtcagcctacgtcgtacgggttttccgggaccgggtaacgggaacccgtaaggcccgttacggtaaccccggttcccgttaacggggtaccccaaccgggtacccccgaaacggggtcccccttcccggttacccccccggttccgggttacccccgg

SEQ ID NO: 151055 - DNA, 805 bp, Homo sapiens
  misc_feature: GYAE6OF01DF9PY.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctccaccctcctcgactcgagggcacgaggggtccgtcgggccctagtctcgccctgactcagcctcgcctcggtgtcgtcgggtctccgtaggacaggtcgactccaacctcttccgtcctgccacgtacgaacccacctacgtgtacgttgtcgttagttaataaatctctctcgtagtactacaacactaccgacgaaccaacccgacccaagtactactacgttaattagtacgtatacgttactaacgttaccgtaccggttcgttaacggtcgggtttacctacgttccgttacttcgttcgtacggtaccttaccgtacgttcgtccggactaccgtcccggtaccctcccgtacgtaccctcggttccgtaccggtaccggaccgtacccggtacggtacgttaaccgggaaaggttaccggaacgtttcgtaacgtttaacgttacgtaccgtacgtaccgtaaccgttcttaaccttaaacgtcggaaccacgggacctacggaccgtactccggttaacggtaccgggttccggggttaacggacccggggtaaagaccgtaaccgggttaccgtacccgggttaaccccgttcgggttaacccgggacccctaaaccgggtaaccccggttacccgggtaccccccggtttacccccgttaccgggttcccccggtttaaccc

SEQ ID NO: 151056 - DNA, 640 bp, Homo sapiens
  misc_feature: GYAE6OF01A2XF9.7.5.A05.1.454.CMB.1.raw
  modified_base (447)..(447): a, c, t, g, unknown or other
  misc_feature (447)..(447): n is a, c, g, or t
tcagcgtgtctctacacgaccggtgctcgatttagatagatagacgaggggggggtctcagggaggcagcgctctcgggacgtctccaccatggcctgggctctgctattcctcaccctcctcactcagggcacagggtcgtgggcccagtctgccctgactcagcctgcctccgtgtctgggtctctggacagtcgatccaccatcctcctgcactacggaaccaccactgacgttgcttaggttaataaatatctctctgtatcaacaactaccaggcaaacgaccccaaagtcatactatttactgtatgttactaattacgtcggtccttacgtagggtttaccaagtcgtcttctcgtcgactccgaagtcgtcggccgaacaccggtccctccgtacgacctactcgttacgtcggcctaccgaggtactaggaagacggnggtactagtagttttactagtcgtcgacgtctacataactacggaagtaccgacgacgacgtacctacgttacggttacgggttaccgggacggggaaacggttaaccgacggtaccgtaccggtacccgtccggtaaccgtcgaacccggaacccgtacccggtccctcccccggtccccgtcggttacccc

SEQ ID NO: 151057 - DNA, 830 bp, Homo sapiens
  misc_feature: GYAE6OF01BZG24.7.5.A05.1.454.CMB.1.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
tcagcgtgtctctacacgaccggtgctcgatttagatagatagacgaggggggggtctcagggaggcagcgctctcgggacgtctccaccatggcctgggctctgctattcctcaccctctcactcagggcacgagggtcgtgggcccagtctgccctgactcagcctgcctccggtgtctgggtcctcgtggacaggtcgatccacctatcctccngcctacgtaccggaaccctaccctacgtcggtacgttgacctttagggtttaaataaacttnttaccttccgtcccgttaggttaactaccgaaactaaacgtacccaacgggacctaaaaccgaccccctaaaggtacctacgtactacgtttattaggtattacgttactaaagttaacggtcccggttacccgttaccggttaacgggggttttacccaaacgtttcccggttaccttccgttacgttacggtacccttaccgtaacgttccggtaggtcccgtaaccggtacccgggtccccttacccgtaacggtaacccgtaccgtttccgttccgggttacgggtcctacccggtacgggtaccgtaacggggtaaaccggtaacgggtacggtacgttacgttaacgtttaactcggttacggactacgtactacgtacgtaactagggacgagagtaccacgtacctacggtacggtttacgggttccgggaagggtaccggaaccggtcggtaccgggttacccgtacgggttacccgtacggtacccggtacccggacggttaaccgggtcccttccccgggtccccgtcggtttaccccgg

SEQ ID NO: 151058 - DNA, 574 bp, Homo sapiens
  misc_feature: GYAE6OF01A6ETF.7.5.A05.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (483)..(483): a, c, t, g, unknown or other
  misc_feature (483)..(483): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctccgtggtatcaacaatacccaggccaaaagcccccaaagtcatcatttangatgtctaatatcgtccttcgacgggtttaccatcgcttctctgctcaagtctagcgacacggcctccgtcgaccntctcgtcggctccgacggtcgtagaacgacgacggtctagtacttaattacgtgctagcctacatacgtacgagcacgcacgctacgtcgtacgggtttccggngggtaccggacctaacggtcgtaccgtaccggttcctacgggtaccaccggtacccaacgggtccctaccggtcccccgtcggttaccccg

SEQ ID NO: 151059 - DNA, 742 bp, Homo sapiens
  misc_feature: GYAE6OF01CTDO8.7.5.A05.1.454.CMB.1.raw
  modified_base (141)..(141): a, c, t, g, unknown or other
  misc_feature (141)..(141): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgaggggggggtctcaggaggcagcgctcgtcgggacgtctccaccagtcggcctgggcctctgcttacttcctccaccctcctcactcagggcacngggtcggtggcccagtctgccctgactcacgcctgcctccgtgtcgtggtctcgtggacagtcgatcaccatctcctgcacgtcgaaccaccacgtgacgttgcttaggttaatatactctctcgtgtacacaacaactaccgagtaccaaaccgacccgaagtcattactatttangtatacgtactaacgtagtccgtacgttacgtagggttaccagtcgtcttcgcgtcgtactccgtaacgtcgtagaccgacgtacccggtcctaccgtcgtactactccgttacggtcgggcccgtacggacgggtaccgtacgggaaacgtacgaacggttaccgttagttaactttacgtttacgaacgtacgtaccgtaacgtaactaacgttaacggtaaccgtacggtaaccgtaacggtccgaacgtttaccgttaaaccgggttcggggtttaacggggtttaccgggaaccgggtaaccgggtaaccgtaccgggtaccggttacccgggttacccggtaacccggttccgggaaccctacccgggtaccccggaacggttcccccgtacccgggtacccccgttcgggttacccc

SEQ ID NO: 151060 - DNA, 922 bp, Homo sapiens
  misc_feature: GYAE6OF01B30TO.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctcgccctgactcagcctgcctccgtgtcgtgggtctccgtggacagtcgatcgacctatcctcctgctacgtacggaacccaccactcggtacgttcgtcgttaggtttaactaaattactcctccttccgttcggttaactacctaaaactaaacgtaaccccgaaggaaccaaaaccgaccccccgtaaaaaggttaccaacttacctaatttttaacgtacgttaacgttacggttacttaaacgttaacgttcccgggttacccgtttaccgggttaacgggggttttaccctaaacgttccgttaccgtttccgtttaccgtcgggttaccctacccggttaaacgttccgttacgggtaccggaaccgacccggtccccttccccgtaccggtaaaccctacttccggttccggttacgggtccccgttaccggtaccgggtacgtaacgaaaccgggtaaccggtacggtacgttaagttaacttttaactttaaccggtccgacggtaacctacttaaccgttaacttaacgtaacgggtaacgaccggtaaggacccgtaacggtaccgttaaccccgttacgggtttaaccgggggtttcccgggggaaccggggtaaacgggtaacccggtaaccgggttacggttaccccgggttaaccccgggttaccggtttaaccgggtaacccgtaaccccgggtacccggtaacccggttaccccggttacccccggtccccccgggttacccggtttaccccgg

SEQ ID NO: 151061 - DNA, 792 bp, Homo sapiens
  misc_feature: GYAE6OF01EIXIC.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtcgggcccagtctcgccctgactcacgcctgcccttccgtgtcgtcgggtccttccgtggactagtcgatccacatcctcgtcgcacgtcggaaccacctacgtggtacgttgcgttaggtttaataaactcttcctcctacctaggtataccgaaactaactacccgaggtacccaaaaccgacccccgtaaagtcctaacgttaccttaatttacgttacgtacgttagttaccgttaagttaaccgtcccgggttaccgtttcgggttaacgggtttaccgttaacgttccgttcctttccgttccgtggtacccttaaccgttaacggtcggttacgggacccgtacccggtacccgggtccccttaccggtaccgaaccgtcttacccggtacggtcccgggtaccggtcccggtagggtctaacgggaacggtacgggacgttactacgttaacgtttaacgttccgtacggtcgacgttcgttaacttacgtaacgtaacccggtacggcgtaaccgacgttccgtactccgggttacgtttcggggtaccgtacggggaccgaaccgtcggaccgttccggaccggttcgaccgtacggtacccggccgtaccggtcccggtacccgtcccgttcggtccccg

SEQ ID NO: 151062 - DNA, 746 bp, Homo sapiens
  misc_feature: GYAE6OF01BC4AJ.7.5.A05.1.454.CMB.1.raw
  modified_base (543)..(543): a, c, t, g, unknown or other
  misc_feature (543)..(543): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcgagggcacgagggtcggtcgggccagtctgccctgactcagcctgcctcgtgtcgtgggtctcctggacagtcgatcacactctcctgcacgtcggaaccacctacgtgtacgttgcgttaggttaataaatactcttcctacgtagtactactaaacaactaaccaacgaacaaaccgacccctaaagtactactactatttagtagtagttacttacttaagtaacgttacggtaccgttacggttaacgggtttacctaacgttccgtctttcctacgtaccgtaccgtacgacgtcgtacggacgtaaccgtaccgtccctacccgtacgtaacctactccgtcgtcggtaccgaccggtaacgtacgtaacggaaaggacgtaacggtcgttaataactttacgttacgngtacctagtccgttaataacgtaacgtaaccgagggtacaacggtacccaagttacccgacgtttccgggtaaaccggggttccggggaacgggtaacccggaacggttaaccggtacgttacccgggttaacgttcccggtaaggtacccgaaccggtcggtaaccccgtaccggttccccggtccccgttcggtaaccccg

SEQ ID NO: 151063 - DNA, 738 bp, Homo sapiens
  misc_feature: GYAE6OF01A48ST.7.5.A05.1.454.CMB.1.raw
tcagcgtgtctctacacgaccggtgctcgatttagatagatagacgagggggggggtctcagggaggcagcgctctcgggacgtctccaccatggcctgggctctgctattcctcaccctcctcactcgagggcacgagggtcgtgggcccagtctgccctgactcagcctgcctccgtgtcgtgggtcctccgtggacaggtcgactccaccatctcctgcacgtcggaaccaccactgtaccgttgacttaggttaataaatctctctcctaggtactaccaaactaactaccgacggaccaaaccgacccccaaagtcatctaatttatgtatctactaactacgtcgtcctacggtacggttacacgtctcttcgtcgtacgtctacgtagtcgacgcgacgacgtccctcgtacgactactcgtcggtcgtccgtacgacggtacgtaacgggaacggtaccggaggttactaacgtttacgtttaaccgtttaccggaggtaacccgtgtaacccttaactaaacggttaccggtaaaccggacggaccgtaaccggtccgaaccggttaaccgttaccgggtttaaccggtttaccggggggttacccgggaacggggtaaaccggaaaccgtacggttaacccggaaccggttacccggtacggtacccggaccgaaccggtaccgggtaacccgtccccgggtccccgtacccggttcgttacccccgg

SEQ ID NO: 151064 - DNA, 719 bp, Homo sapiens
  misc_feature: GYAE6OF01EZPLK.7.5.A05.1.454.CMB.1.raw
  modified_base (332)..(332): a, c, t, g, unknown or other
  misc_feature (332)..(332): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggcagtcgatcaccatcctcctgcacgtacggaaccctaccacgtgaccgtttgccttagggttaataaatagttccttcctccgttaggtactaccaaactaacgtaacccgaggaccaaaacgacccccccgaaaagttaccntaactactaatttagattacgtacgttacgttaacgttacggttacgttaccggtaccggtttaccgtaacgggtttaccgtactcgttcgtcgtctcgtacgtcctaggtcgtacgacggaccctacccgtccgtaccctacgtacctcgtcgtccgtccggtccgtccgtaggaacgtaacggaacgggtaccgtacggtacgttactaacgttacgttacgtcgcctaacacttaactaacgtaagtacgaacggtaccgaagcaacgtacgtaccgttacggtacgggttaccgggaccggaacggtaccgtacggtaccggttcccgtaccggttaccgtaccggtaccgacggacccgtacccggtccccgtcgtcccccg

SEQ ID NO: 151065 - DNA, 808 bp, Homo sapiens
  misc_feature: GYAE6OF01AV2PV.7.5.A05.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (471)..(471): a, c, t, g, unknown or other
  misc_feature (471)..(471): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctcgccctgactcgagcctgccctcgtgtctgggtctccgtggacagtcgatcacntctcngcacgtacggaacccacactgacgttgacgttagttaataaactctctctcgtagtactacaacaacgtacccaggaactaaaccgaccccgtaaagtacagttactatttactgtacgtcgttacgtaataccgttccgggtaccgtttaggttaccggggtttacctaacgtttccgtactttcgtaccgtacggtaccttacccggaacgtttcgtacggaccgaccgtacccggtaccccttacccgagtaaccctnttccggtaccgtcgggtcccctaccggtacggtcgtaacggtaaacggaccggttacgggtacccttaaggtttaaactttacccggttacgaccggttacgtaaccgtcctaaggtaaccttaacgggttaaacgccgggaactaccggggtacccaggttaacccgttacggtttccggttaagggttaacccgggcgggggttaaaccgtaaccggtaccgggtacgtaacccgggtttacccggttaaccggttcccgggtaaccgaccccgggttaaccggaacccggggttcccccttccccgggttccccccgggtaacttacccccggg

SEQ ID NO: 151066 - DNA, 738 bp, Homo sapiens
  misc_feature: GYAE6OF01AYJCQ.7.5.A05.1.454.CMB.1.raw
tcagcgtgtctctacacgaccggtgctcgatttagatagatagacgaggggggggtctcaggaggcagcgctctcggggacgtctccaccatggcctgggctctgctattcctcaccctcctcactcagggcacagggtcgtgggcccagtctgccctgactcagcctgcctccgtgtcgtgggtctccgtggacagtcgatcaccatcctctgcacgtcggaacccaccgtacgtcgacgttcgtacgttggttaataaatcttccttccttccgttaggttaactaccaaacgtaaacttaccccgaaggtaccaaaaccggaccccccaaagtacctaactactaagttttatagtatacgtacttaactaacgtccggtccgttacgttacggggttacctaacgttcgtacttcgtcgtcggtcctaccgtaatcggtacggaccggacgccggtccctacccgtacgtaccgtactccgtcgtcgggtctaccgtggtctaacggaacgtacggacggtacgtaagtacgtttaacgtacgtcgtactacggtcttacctaagttaacgtaccgaaggttcccgaaggtcccgtaaagtcccgtacggtttacgggtacgggtttaaccgggaccgggtacgggtaaaccgtaccggtcgtaccggttaaccggtcgtaaccggtcgacccggtaaccgtccgacccggtcccgtcccccgttgttaccccg

SEQ ID NO: 151067 - DNA, 919 bp, Homo sapiens
  misc_feature: GYAE6OF01DOJ82.7.5.A05.1.454.CMB.1.raw
  modified_base (123)..(123): a, c, t, g, unknown or other
  misc_feature (123)..(123): n is a, c, g, or t
tcagcgtgtctctacacgaccggtgctcgatttagatagatagacgagggggggggtctcaggaggcagcgctctcgggacgtctccaccatggcctgggctctgctattcctcaccctcctnactcagggcacagggtcgtggcccagtctgccctgactcagcctgcctcgtgtctgggtctcgtggacagtcgatcaccatcctcctgcacgtacggaaacccaccacgtgacgttgccgttaggtttaaataaacttctcctttaccttcccgttagggttaactacctaaaactaaaccttaccccgaaggtacccaaaaccgacccccctaaaaggttcctaataccttaatttagtacgtaattgttaacctaattaacgttccgggtccctttacggtaagggggttttaccccaaacgttccggtaccttttaccgtcgttcgggtaccctttaacccgtaaacggttccggttacgggtacccggtaacccggtaacccgggtccccgtttaccccgttacggtaacccctacgtttacccgttaccggtccggggtacccttacccgggtaacgggtaccgttaacgggaaaccgggtaccgggaacgggttacgttacggtttaacttttaacgttaccggttacgtaccgtacggttacctacgttaacgttaacgttaaccggaacgggtaccgacgggtacgtaaccggtaccctaaccggtttaccgggtttacggggttttacccgggggaacccgggttaaaccggggtaacccgtaaacgggttcccgttaaccgggtaccccggttaccgggttaacccggtaaccggtaacccgggtaccccggtaaacccgggttcccggtttaaccccggcccccccgggtttcgggtaacccccg

SEQ ID NO: 151068 - DNA, 830 bp, Homo sapiens
  misc_feature: GYAE6OF01EBIY3.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctccaccctcctcactcgaggcacgagggttcgtcgggcccagttcgtcgcccctgtacctcagccctcgcctccggtgtcgtgggtcctccgtggacagtccgactccacctactccttccgtcgactaaccgtacgggaaaccctacctaacgttcggtaccggtttacgtccgtttaaggttttaaaacttaaaaagttccttccttaccgttaccgttgggttaaacctacctaaaacctaaaccttaaccccggaaagggtaacccaaaaccccgtaaccccctaaaagtacctactttaccttagttttaattacgtacgttacgttaacctttaagtaacgtccgttaccgtttaccggtacggtttactacgttcgtacttcgtcgtacgtctaccgttaaggtccgacggtaccgtaacgtacccgtccccgtacgtaccgtaccctccgttccttacgggttcgacctaccgtagggaccggtaaaggtaacggtacgggaaccgttccggttagtttaacgtttacgttacctcggtacaccgttctaacgtactaacggtagaaccggtacacgtaacctcggtacttaccggtacgggtttacggggtaccgggcgggttaaaccgacggtaccggtccacgggttacccgtacggtacggcgtacccggacggtacgccccgtacccgtcccgttccggtacccg

SEQ ID NO: 151069 - DNA, 736 bp, Homo sapiens
  misc_feature: GYAE6OF01DL9HL.7.5.A05.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
tcagcgtgtctctacacgaccggtgctcgatttagatagatagacgagggggggggtctcaggaggcagcgctctcgggacgtctccaccatggcctgggctctgctattcctccaccctcctcactcgagggcacaggggtcgtgggcccagtctgccctgactcagcctgcctcgtgtcgtgggtcctccgtaggacagtcgatccaccntctcctgccacgtcggaacccaccacgtgtacgttgtcgttaggttaataaagttcncttccgttccgtagtacaacaaacctaactaacccgaacggaaccaaacccgaccccaaaagtcacttactaatttagtacgtatacgttactaagttaacgttccgggtactttacggtacgggtttaccaacgttccgtcctttcgtcgtacggtccttaaccgtacgttccgacggtaccgaccgtacccggtccctcccgacgtaccctgttaccgtcgtcgggaccctccggtaaggtacgtaacgggaacggacggtaacggtacgtttagtaacctttagtttaccgacgacttacgttactaccggtataaggtaccacggtacggacaccgagtacccttacgtcgggtttaggttaccggggaccgaagggtaccgacggttacccgacgggtacccgtacggacgtacccgaacgtcccggtagtcccccggtacccggccccctttcgggtaccc

SEQ ID NO: 151070 - DNA, 649 bp, Homo sapiens
  misc_feature: GYAE6OF01DLARW.7.5.A05.1.454.CMB.1.raw
  modified_base (190)..(190): a, c, t, g, unknown or other
  misc_feature (190)..(190): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (292)..(293): a, c, t, g, unknown or other
  misc_feature (292)..(293): n is a, c, g, or t
  modified_base (457)..(457): a, c, t, g, unknown or other
  misc_feature (457)..(457): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctcgtgtctgggtctcctggacngtcgatcaccatctcctgcactggaaccacatgacgttnctggtataaatctctctctgtancaacaactaccagacaacgccccaaagtcatctattactnntgtctataactcggcctttcgtacgggtttcctaatcgtcttctcgtcggcctaccgaagttcctggcgacgtaccggtccctaccgtcgaacctagtccgtcgttcgggcctccgaacgtcctagggaaacggacggaacggtcgtagttacttatttaaccngacgtacggtctacgtacttacgtaaccgaggacgtagccgaagcccgtaacttcgtacgggttttcccgggaacgggtaccgggtaaccgaaggtcccggttacggtacccgtttacccggttaaccgggtaccgtaaccggtaccccggtaaacggcccgttacccgtccccccggtggtttaacccccg

SEQ ID NO: 151071 - DNA, 700 bp, Homo sapiens
  misc_feature: GYAE6OF01ELS7H.7.5.A05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
tcagcgtgtctctacacgaccggtgctcgatttagatagatagacgaggggggggtctcgaggaggcagcgctcgtcgggacgtctccaccatggcctgggctctgctattcctcacccctcctcactcgagggcacgagggtcgtgggcccagtctgccctgactcagcctgcctcgtgtctgggtctccgtggacngtcgatcacatcctcctgcacgtcgaaccncacgtgacgttgcttaggttaataaatctctctcgtagtatacaactaactaccgagacaacgaccccaagtcatctattagngtatgtactaatacgtcgtcttacgtagggttaccagttcgtctttctcgtcgtacctacgtacgttccgtcggaccgtaaccgtacccgtacccttcccgtacgtacccgtacttccgtccggttcgggtaccttacccggtaagggtaccgtaaggtaaaccggacggtaacggtacgttacgttacgtttaacgttcgtacgtacgtacgtactacgtaacgtaagtacggacggtacgagacgaacgtacgtacgtttacggttaacggggtttccggaccgggtaacgggacccgttacggccgttaaccgggttacccggtaccggttacggaccacccgggtaaccgtaccggtcccgtaccccgtccccggtcgttacccg

SEQ ID NO: 151072 - DNA, 729 bp, Homo sapiens
  misc_feature: GYAE6OF01E5MHM.7.5.A05.1.454.CMB.1.raw
  modified_base (571)..(571): a, c, t, g, unknown or other
  misc_feature (571)..(571): n is a, c, g, or t
  modified_base (684)..(684): a, c, t, g, unknown or other
  misc_feature (684)..(684): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgagggcacgagggtcgtcgggcccagtctcgccctgactcagcctgcctccgtgtcgtcgggtcctccgtggactagtcgatccacctactcctcctgacacgtacggaacccaccacgtcggtacgttgtcgttaggtttaataaactacttccgtcctaccgttggtaactaccaaactaacgtacccgaagtaacccgaaaccgtacccccaaagtactactaccttatttagtagtagtcgttactaacttacggtccgttccgtttacggttaccgggtttacctaacgttccggtacctttccgcgttacggtaccttaccgtaacggttccgtacggtcccgaaccggacccgtcccctacccgtacgaccctagtccgttcgtacggcctaccgaggtacgtaggaacgacggtcgtacgtagtacttactaccgtnacacgtactactatacgacgacgacgactaccgaacgtcctaccggttaggttacggggttcggaccgggtacggaaccgtacgtccggtaccggtacctacgggacgtaccnccggtaacccgacggttaccccgcccggtaccccgtcgttacccg

SEQ ID NO: 151073 - DNA, 802 bp, Homo sapiens
  misc_feature: GYAE6OF01BYB0F.7.5.A05.1.454.CMB.1.raw
tcagcgtgtctctacacgaccggtgctcgatttagatagatagacgagggggggggtctcaggaggcagcgctcgtcgggacgtctccaccatggcctgggctctgctattcctcaccctcctcactcagggcacgagggtcgtgggcccagtctgccctgactcagcctgcctcgtgtctgggtctctggacagtcgatcacatctcctgacacgtcggaacccaccgtacgtggtacggtttgaccgtttagggtttaaataaaacgttcttccttaccgttcccgtttagggttaacttaaccaaaccgtaaaccttaaccccgaacgggaacccaaaaacccggtacccccccgtaaaaggttaccctaacgttacctaattttaacgtacgtaacgttacggttaccttaaagttaaaccggttaccgggttacccgtttaccggttaacggggttttacccaaacgtttcccggtaccttttccgtcggttcgggtacccttaaccgtaacgttccggtacgggaccgtacccgtaacccgggtcccttacccgtacgtaacctacgttccgttccggtcgggtaccctaccggtacgggtaccgttacgggaaccggtaaccggacggtacgttacggtatttaccgttacgtcgtacgactactactaactacgtacgtagggaccacggacacggtcctaacgttcggttacggttcggggacggtaaccggacacggcgtacgtaacggtcgtacgaccgacgccgtaacgtccgtcccgccgttcgtaccg

SEQ ID NO: 151074 - DNA, 695 bp, Homo sapiens
  misc_feature: GYAE6OF01E3VAE.7.5.A05.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtggcccagtctgccctgactcagcctgcctccgtgtctgggtcctcctggacagtcgatcaccatctctgcactagaaccnccatgtacgttgctaggtaatatntctcgtcctggactacaactaactacccgaggtaccaaacgaccccccaaagtcaacttctatttangtatggtactaatacgtccgtaccgttcgtacgggttactacgttctcttacctcgtcgcctaccgtaagtcgcggtacgaccgtaccgtcccgtacctacggaccctactccgtacggtaccggccttaccggacgtacgaggaacgacgtggacttagacttacgttaacgtcgctacgactacgtaataccgtacgacggacgtaacgcctaacgcgtaccgtttacggtaccggggttttcgggaacccgggtaccgggaacccgtaacgggtaccctacggggttaacccctccgggttaaaccggttccgaaacccgggaccccggttaacggcccgggttacccccgggtccccctttaccccggggttaacccc

SEQ ID NO: 151075 - DNA, 561 bp, Homo sapiens
  misc_feature: GYAE6OF01BI4G0.7.5.A05.1.454.CMB.1.raw
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttataaatatctctcctggtatcaacaatacccaggacaaacgcccccaaagtcatcatttatgatgtctactaatcggcttcgtagggtttccaactcgtcttctctgctcagtctggcgacncgcctcctgacatctcgtggctccgagctgaagcgacggntagtatttatctgcacgctcatanacgagcagtcgagctactacgtacgggtttccgggacgggtacgggaacccgtaggccgttacggacccggttccgtacgggtccgaaccggtacccgaacgggtcctcccggtcccccggtcggttaccccg

SEQ ID NO: 151076 - DNA, 701 bp, Homo sapiens
  misc_feature: GYAE6OF01C6PRV.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagccttgcctccgtgtctgggttctcctggaccagtcgatccaccatcctcctgcactggaacccacactgacgttgctaggttataaatntctacttcctaggtactacaaactaaactaacccaggacaaacgaccccctaaagtcatctaatttatgattgtacctataactcggcctttacgtacggggtttccaaatcgtcttactcgtacgcttaccgagtcgtgaccgacacggcctcctcgactactctctcggtcctaccgacgcgtagaacggtacggaggtactaggtaactttagttaacgtgcgtagtactacaacgttactaacgtacggacgtaacggactacgtaccgtaaccgttccggttaacgggtttacggggtacccggggtaacgggttaaacccggaacggtaacccggttaaccggtaacccgggttaccgtaaccggggtttaccgacccggaacccccgggtaaacccgggtcccggttacccccggtccccccggttcccgggtttaacccc

SEQ ID NO: 151077 - DNA, 716 bp, Homo sapiens
  misc_feature: GYAE6OF01AM52D.7.5.A05.1.454.CMB.1.raw
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctcgccctgactcagcctgcctccgtgtctgggtcctccgtggacagtcgatccacatctcctgcacgtgaaccncatgacgtgacttagttaataatctcctctcctgtatacaacaactaccgaggtaccaaccgaccccgtaaatcatatactttanagtagtntacgtatactcggtccttaggtacgggttccaactcgtcttcgtcgtcggtacctacacgtcgtcggacgtaccgaccggtccctaccgtctacctacgtcgttaccgtcggtacctaccgacggtacgtacggaacgacggtacgtacgtagttaactttactacgtcgtacgtacgtcgtacttaacgtactaccgggtaaggacgacgtacgtaccgacggttacctttacggggttaacccggggttacgggtaaccggggaacgggttaacccggaaccgttacccggttacccgggttaaaccccggttacggttaacccggtaccggaacccggtaaccccggtacccggtacccgtacccccggttaccccggtacccggtttaccccgg

SEQ ID NO: 151078 - DNA, 674 bp, Homo sapiens
  misc_feature: GYAE6OF01EIWU4.7.5.A05.1.454.CMB.1.raw
  modified_base (252)..(252): a, c, t, g, unknown or other
  misc_feature (252)..(252): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacaggggtcgtgggcccagtctgccctgactcagcctgcctccgtgtctgggtctccgtggacagtcgatcaccatcctcctgcactcggaaccaccactgacgttgctaggttaataaatntctctctggtatacaacaactaccagacaaacgccccaaagtcatctatttatgtatgtactaataacgtccggtaccttacgtacggggtttacctaagtccgtacttctcgtcgtctactaacgtcgtcggaccgtacgaccggtccctccctacggacctacttcctccgtcggccctacgacggtacgtacgaaaggacggacgtacgtagtaactttacgttaacgtcgacgtagtcttacaagttaactaaccggtacggaccacggtacctaacggtacctaaccgttacgggttaccgggtttaccgggacggggtaaaccggaaccgtaacggtccgttaccggtacccggtacgtacggtacccgaaccggtacccgtacggtcccgtacccggtccccgtacggtaccccg

SEQ ID NO: 151079 - DNA, 687 bp, Homo sapiens
  misc_feature: GYAE6OF01BXA90.7.5.A05.1.454.CMB.1.raw
  modified_base (482)..(482): a, c, t, g, unknown or other
  misc_feature (482)..(482): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctggtctcgtggacagtcgatccactatcctcctgcactacggaacccaccactggacgttgacttaggttaataaatcttcttcctctgtactacaaacaactaccgaaggaccaaacgaccccaaagtcactactatttatgtattgttacttaagtaacgtccggtacgtttcggtacgggtttacctaattccggtccttctacgtcgtacctaccgtaagtcgtcggacgaccgtcccggtccctccgtacgacctcttaccgtcgtccggtcctccggagtccgtaaggaacgacggnggtactagttactttacgttacagactacgtctactagtaactacgtacgactacgtacgacgtactacgtacgggttacgggttcgggaacgggtaccggaaccgtacggtccgtacccgggtacccttaccgggtaaccgttacccgaacccggtacccgtaacggtccccgttaccccggtccccgttacccgggtaccccg

SEQ ID NO: 151080 - DNA, 753 bp, Homo sapiens
  misc_feature: GYAE6OF01CNUH9.7.5.A05.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (708)..(708): a, c, t, g, unknown or other
  misc_feature (708)..(708): n is a, c, g, or t
tcagcgtgtctctacacgaccggtgctcgatttagatagatagacgagggggggggtctcaggaggcagcgctcgtcgggacgtctccaccatggcctggctctgctattcctcaccctcctcactcgacgggcacgtagggtcgtcgggcccagtctcgccctgactcagcctcgcctcgtgtcgtgggtctccgtaggacncgtcgactcacctatcctcngactacgacggaaccnctactggtacttcgtacgttaggtaaactactctcttcgtaccgtggtaactaaccaaacaacctaacccgtaacgggaaccaaaaccccgtacccctaaaagtcctaattaaccttaagttttacgaggtattacgttactaagttacgttccggttaccgtttacgggtaaccgggtttacctaacttccgttcgtttacctcgttaccgtaccttaccgtaacgggttcaccgggtacacccggttaccggcccctacgaccgtaaccttcgtacccgtcgttccggaccgttaccgtacggcggtaaggacggtacggtacgttacgtacttactttacggttactacgtcgtacgtactacacgtaacgacgaacgcacgtacgacgtcgttaacgtcggttaccggggtaggaccggaaccgacggtaacgtccggtacggtaaccgtacggtaccgggtacncccgggtaacgacccgttcccggtcccggttcccgtccgtacccg

SEQ ID NO: 151081 - DNA, 769 bp, Homo sapiens
  misc_feature: GYAE6OF01CT7R0.7.5.A05.1.454.CMB.1.raw
  modified_base (113)..(113): a, c, t, g, unknown or other
  misc_feature (113)..(113): n is a, c, g, or t
  modified_base (125)..(125): a, c, t, g, unknown or other
  misc_feature (125)..(125): n is a, c, g, or t
  modified_base (136)..(136): a, c, t, g, unknown or other
  misc_feature (136)..(136): n is a, c, g, or t
  modified_base (220)..(220): a, c, t, g, unknown or other
  misc_feature (220)..(220): n is a, c, g, or t
  modified_base (654)..(654): a, c, t, g, unknown or other
  misc_feature (654)..(654): n is a, c, g, or t
  modified_base (677)..(677): a, c, t, g, unknown or other
  misc_feature (677)..(677): n is a, c, g, or t
  modified_base (723)..(723): a, c, t, g, unknown or other
  misc_feature (723)..(723): n is a, c, g, or t
  modified_base (761)..(761): a, c, t, g, unknown or other
  misc_feature (761)..(761): n is a, c, g, or t
tcagcgtgtctctacacgaccggtgctcgatttagatagatagacgaggggggggtctcgaggaggcagcgctcgtcgggactctccacatcggcctggctctgcttattccncaccctctcacncgaggcaacgngggttcgcgggacccagtctcgaccctgactcgcgctcgtcctccgtgtcgtacgggtctaccgtggactagtcactccaaccnttcctccgagacccgtaacgtaccggaaaccctacgtgtacggtaccgttggtacttaaggttaactaaaccttctcctcgttaccgtaggtaactaccaaaactaaccgaccgaacggtaaccgaaaaccgtacccctaaagtactaaccgtttataacgtttacgtctacgttacttaaccttaaagttacccggttccggttaccgtttaacggggtaaccggttttacgtaaacggtttccgtacgttttccgtcgttaaccggtacggtttaccggtacgtttacccggggcgttaacccggaccgtaccccgggtcccttacccgggtaacctacctacggttccgtacccggtacggtacccttaccggagttacgggaacgtaacggtcgaacgggttactttaggtacttaacgtgaaacccgtnttaaccaccggtataaccctagngacgtcggaactcgtacctacgactgggttacgcggaacgcgtaancgcgtaccgctcgacaggtacccggactacgcccgtcnggttaccc

SEQ ID NO: 151082 - DNA, 828 bp, Homo sapiens
  misc_feature: GYAE6OF01CPOZM.7.5.A05.1.454.CMB.1.raw
tcagcgtgtctctacacgaccggtgctcgatttagatagatagacgaggggggggtctcaggaggcagcgctctcgggacgtctccaccatggcctggctctgctattcctcaccctcctcactcagggcacgagggtcgtggcccagtctcgccctgactcacgcctcgcctcgttgtcgtgggtctccgtggacagtcgaatcaccactcctccgtgacctacgtacggaaacccaccgtactacggtacgttagtaccgtttaggtttaaactaaacttcttccttccgttacccgtaggttaactacctaaaacctaaaccgtaaccccggaaggtaaccgaaaacccggacccccctaaaagtaccgtaacgtttaacctaatttttacgtacggtaacgttaccgttaacttaacgttaaccggttccgggttacccgttttacgggttaaccggggttttaccctaacggtttcccgttccgtttccgttacggttaccggtaccttaccggtaacgttccggtacgggaccgtaacccgtacccgggtcccttacccgtaccgtaccctacgttccttaccggtaccgggtcccgtacccgagggttccgtaaggaacggacgggtaagttacgtagtttaacttacgtttacgcacgtacctcgtaactaacgttacgaacgtacggaccaagtccggactacccggtaaccggttaccggttacggggttaccgggacggaaccgggtacaacggtcgtaccggtaccgtcgtaaccgtccgaccgtaccgaccgtcaccccggtccgccggttaccc

SEQ ID NO: 151083 - DNA, 947 bp, Homo sapiens
  misc_feature: GYAE6OF01BHUO6.7.5.A05.1.454.CMB.1.raw
tcagcgtgtctctacacgaccggtgctcgatttagatagatagacggagggggggggtctcgagggaggcagcgctcgtcgggacgtcctccaccagtcggccgtgggccttcgtcgtcttacttccctcctaccccttcctctactcgacgggcacggtacggggttcggtcgggccctagttcctccgtccctgtacctcgacgtccgtccgtcccgttccggttcggttcggttcgggttcctccggtaggacgtcgtaccgtactaccaacctcttccttccgtcgacctacgtaccggaaccctaccgtacgtcggtacgttcgtacgtttaagttaactaacttcttccttccgttacgttaagtaacctaacctaaacctaaccgtaacccggaaacggtaaacccaaaaccccggtaaccctaaaagttaccttaaactttaacgttttaaacgttttaggtaacggttaacttacgtttaacgttaaacggttaccggttcccggtttacggtttaaccgggttaaccgggttttaccactttccgttccgttacgtcgtcggtacctacggtacgtcggtaccggacccgtaccgtcccgtaccctacgaaccgtaccttcgtcggtacggtccggaccgttacggcggtaacggaacgggtacggtaacggtacgtttacttaagtttaccgtttacgtacggcgtaccgtaactccgttaaacgtaacgtaacggacggaccgtcgtaacgtaccctcgggtttacgttaccgggttacgggttacgggggaacccgggaacggttaaacccggaacggttaccggtccggttaacccgggttaacccgggtaccgttaaccccggaccgggtacccgggttaaccgttaccccggttcccccgtaacccccgggtttcccgtaccggttacccg

SEQ ID NO: 151084 - DNA, 755 bp, Homo sapiens
  misc_feature: GYAE6OF01EW5O6.7.5.A05.1.454.CMB.1.raw
  modified_base (135)..(135): a, c, t, g, unknown or other
  misc_feature (135)..(135): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgagggcagngggtcgtcgggccctagtctcgccctgactcagcctgccctcgtgtcgtggtcctcgtggacagtcaactcactntcctccngactacgtacggaaccaccagttcgtacgttcgacgttaggttaaataactcgtcttctaccgtaggtaacttacaaaacctaacgtacccgaacggtaaccgaaaaccgtacccctaaaacgttacctaacttaccgttaagtttaagtacgttacgtacgttactaaacgttacggttcccggttacctttacgggttaacgggttttaccctaacgttccgttaccgttccgtcttccggtaaccttccgtaagtcggttacgggaaccgtaacgtccggtaccctacccgtacgacctacgtcttccggtcggtccgtacgtaacggtcgtaacggacggtaacggagtacgttacgtaactttacgttacgtcacgtactactacctataacgacgtacggacgtaccgactacgtctacgttaccggttagggtacggaccggggtaaacgtaccgaacggtccgtacgggttaccgtcggttacgaccgaccgacccggtacgtacccgtcccggtcccgttccgtacccg

SEQ ID NO: 151085 - DNA, 665 bp, Homo sapiens
  misc_feature: GYAE6OF01A4CYP.7.5.A05.1.454.CMB.1.raw
  modified_base (185)..(185): a, c, t, g, unknown or other
  misc_feature (185)..(185): n is a, c, g, or t
  modified_base (544)..(544): a, c, t, g, unknown or other
  misc_feature (544)..(544): n is a, c, g, or t
  modified_base (576)..(576): a, c, t, g, unknown or other
  misc_feature (576)..(576): n is a, c, g, or t
tcagcgtgtctctacacgaccggtgctcgatttagatagatagacgaggggggggtctcaggaggcagcgctctcgggacgtctccaccagtggcctgggctctgctattcctcaccctcctcactcgaggcacgagggtcgtgggcccagtctgccctgactcagcctgcctcgtgtctggtcnccgtggacagtcgatcaccacttcctcctgacacgtcggaaaccactacgtgtacgtgacgttagtaataactacgttctacgtcgtagtactacaactactaccgtagaccaaaccgaccccgtaagctacgtactaacttatacgtatagtacttacgtaacgtcgttacttcggtacggttactaagtccgtccttcgtacgtcgtacgtactaacgtcgtacggtacgacgaccgtcctacctacgaactcgtcgtcgtcggtcgtaccgtacggtacgtaacggaacgtacggaggtacgtacgttattaccgtacgcgtaccgtagtcctaactatacgtaacggtacgacgntaccgacgtaactccggtacgttggtaccggnggacggtacccgaggtaccgtacggacccggttcgaacgtccggaacccgtaccggaccggtcccgaccgtccccgtcggttaaccccg

SEQ ID NO: 151086 - DNA, 605 bp, Homo sapiens
  misc_feature: GYAE6OF01EY8M5.7.5.A05.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
tcagcgtgtctctacacgaccggtgctcgatttagatagatagacaggggggggtctcagggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctctgcactggaaccacactgacgttnctgttataatntctctcctgtatcaacaataccaggacaaacgacccccaaagtcatcatttangatgtactataatcggtccttcgtagggtttaccaatcgtcttctctgctcagtctggcgacacggcctccctcgacctatcctcgtacggctcccgaggtactacggaaagacggaaggtctagtatttacgttactgcacgtctactattaacgtacgtacggacgtacgacacgtactacgttacggttacggggtttacgggaccgggttaacgggaaccgaacggtcgtacggtacccgttccggtaccgggtacaaccggtacccgacggtacccgttcccggtacccccggttcgtaccccg

SEQ ID NO: 151087 - DNA, 699 bp, Homo sapiens
  misc_feature: GYAE6OF01B6W2B.7.5.A05.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagcgtgtctctacacgaccggtgctcgatttagatagatagacaggggggggtctcagggaggcagcgctcgtcgggacgtctccaccatggcctgggctctgctattcctcaccctcctcactcagggcacgagggtcgtgggcccagtctgccctgactcgagcctgcctccgtgtcgtgggtcctcctggacngtcgatcacctatcctcctgacacgtcggaaccaccacgtgacgttgtactaggtttaanaaattatcctctcgtgtatacaacaactaccgagtaacaacgaccccaagtcaatctatttatgattgtactaagttacgtccgtaccttacgtacgggttactaacgtccgtcttcgtcgtcggtcctacgtaagtcgtggaccgtacgaccggtcccttacccgacgtaccctcttaccgttccgtcggacccttccgacggtccgtaaggtaaccggacggtacggtacgttacgttaagtttaaccgtttacgtacgtacgtacgtacccgtataaccgtaacaaccggtaacgtaccgagtaccgacgtacctacggttaccggttacggggttaccgggacgggttaaaccgggaacccgtaggtaccgtaccggtaccggtacgtacgtaaccgaccgtaccgacggtacccgtcccgtaccccgtcgtacccg

SEQ ID NO: 151088 - DNA, 817 bp, Homo sapiens
  misc_feature: GYAE6OF01A17YE.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggccagtctgccctgactcacgcctgcctccgtgttcgtggggtcctaccgtgggactacggtcgactccgacctactcctcctcggacctaacgttacggaaaccctacctaaaccgtggtaaccggtttcggtccttagggttttaaactaaaagtcttctccgttccgttaggtaactaccaaaccaaacttaacccaacggaacctaaaccgaacccccaaagtaccaacttaccgtatttacgtagtaacgtcgttacgttaattaacgtccggtaccgtttacggtacgggtttaccctaacgttccggttcctttccgtcgttacggtacccgtacgtaacgttcgtacgggtacaaccgtacctaccgtcccgttacctaccggaccgtaacgtcctacggtcggtaccctacggacgtacgttacggaacggtaaccggtcggtaccttagttaacgtttacttacgtacggtacacgttactacaacgttaacgtactaacgggacgaacgacctaacgggaccttacgggggtaccttacggggtttacgggaaccgggtaaccggaaccgtaacgggtaccgtaccggttaccccgttaccggtacggtacccggtaaaccgtacccggaaacggttccccggtccgttacccccgttcccggg

SEQ ID NO: 151089 - DNA, 662 bp, Homo sapiens
  misc_feature: GYAE6OF01AW2X7.7.5.A05.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcacgtcgaaccaccactgacgttgctggttaataaatntctctcctggtatcaacaatacccaggacaaacgcccccaaagtcaatctatttangatgtactataatcggtccttgtacgggtttccaatcgtcttctctcggtctcctaacgtcgtacggccgaaccgaccggtccctcccgtacggaccctactccttaccgtcgggtccctccgacggtcgtaggtaaacggacggtacggtacgttagttaacgtttaacttacgtcgacgtacgtaccttactaactaacgtaacgaacggcgaacgtacgacgcctaacgttacgttacgggtttccgggacgggtaacgggaaccgtaacggtccgttacgggtacccggttacgtacggttaccgacccggtaaccgaccggtcctccccggtcccccggttccggtaaccccg

SEQ ID NO: 151090 - DNA, 674 bp, Homo sapiens
  misc_feature: GYAE6OF01C0KM1.7.5.A05.1.454.CMB.1.raw
tcagcgtgtctctacacgaccggtgctcgatttagatagatagacgaggggggggtctcaggaggcagcgctcgtcgggacgtctccaccatggcctgggctctgctattcctcaccctcctcactcgagggcacgagggtcgtggcccagtctgccctgactcagcctgcctcgtgtcgtgggtctccgtggactagtcgatccacctacgtcctcctgacctacgtcggaaaccctaccgactgtaccgttgacgttaggttaaatactacgtcctcttccgtagtactaactaaacgtaactaacccgaaggacctaaaccgacccctaaagtcctaacttcgtaatttagagtagttacgtactaagtacgttcgtaccgtttacggtacggttaccagtcttcttcgtcgtcgacctcgacgtcgtacggcgtaaccgcccgtcccgtactacgtacgttaccgtccgtacgtcggaccttaccggacggtacgacggaaaggtccgagttacgtacgttacttacgttacgtgactatacctagtaacttacgaacgacgtacacgtcgacgttactacggttcgtacgggttacggacggactacgacgtcgtcgttaccgaacggtcgtaaccgcgtacccgagtcccgtccggtccgtcgtaccg

SEQ ID NO: 151091 - DNA, 722 bp, Homo sapiens
  misc_feature: GYAE6OF01A2Q49.7.5.A05.1.454.CMB.1.raw
  modified_base (204)..(204): a, c, t, g, unknown or other
  misc_feature (204)..(204): n is a, c, g, or t
  modified_base (319)..(319): a, c, t, g, unknown or other
  misc_feature (319)..(319): n is a, c, g, or t
  modified_base (533)..(533): a, c, t, g, unknown or other
  misc_feature (533)..(533): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacagtcgatcacntcctctgcactcggaaccaccactgtacgttgcttaggttaataatctcctctccgtgtaactacaactaacgtacccgagaccaaaccgacccccaagtacactactaatttanagtatcgtacttaagtacgtaccggtactttacggtacgggttttaccaacgttccgtacctttccgtacgttcggtaccttaccgtaacgttcgtcggaccgtaccgtacccgtccctacccgtacgaccctactcgtccggtcggtcctccgaggtactaacggaagaccggagtaccgttagttaatttacgtcgcgtacgctaccgttanaacttagtacccggagacgacgtacgacgtaccgtacgttaccgggttacgggttacccgggttaagggaaccgtaaacccggttacgaccggttacccggtaacccgggttccgaacggttaccccggaaccggtacccccgggttacggtaaccccggttccccggtaccccggttcgttaaccccg

SEQ ID NO: 151092 - DNA, 751 bp, Homo sapiens
  misc_feature: GYAE6OF01A4E4J.7.5.A05.1.454.CMB.1.raw
  modified_base (197)..(197): a, c, t, g, unknown or other
  misc_feature (197)..(197): n is a, c, g, or t
tcagcgtgtctctacacgaccggtgctcgatttagatagatagacgaggggggggtctcgaggaggcagcgctcgtcgggacgtctccaccatggcctgggctctgctattcctcacccctcctcactcgagggcacgagggtcgtggcccagtctgccctgactcagcctgcctcgtgtcgtggtctccgtggacngtcgatccactattcctcctgactacgtacgaacccaccagtcgacgttgacgttaggttaaataatctcctctaccgtaggtactaaccaaactaaccgtaaccgaccgaaccgtaaaacccgtaacccccgtaaagtacctaactaattacgtttaatagtagtacgttactaagttaacgtccgttaccgttaggtacggttacctagtccgtacttcgtactcggtactacgtacgtcgtcggtaccgtaacgcccggtaccctccgaccgaccttacgtccgttggacccggtcctaacggtacgtacggtaacgaacggtaacggaaccgttcgttaaggttaactttagtaaccggtcgtaccgtacgtactacgtaaacgtacgtaccggaacgtactaacgggaccgttaacgtacccgttaacggtttacggtaccggggttaaccggacgggtaaacccgacgtaacggtcctacccggtaacccgtggtaccgaccggtacgtacccggtacccgtacgtccccgtcccgggtcctaacccg

SEQ ID NO: 151093 - DNA, 732 bp, Homo sapiens
  misc_feature: GYAE6OF01CF9LR.7.5.A05.1.454.CMB.1.raw
  modified_base (164)..(164): a, c, t, g, unknown or other
  misc_feature (164)..(164): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
  modified_base (461)..(461): a, c, t, g, unknown or other
  misc_feature (461)..(461): n is a, c, g, or t
  modified_base (567)..(567): a, c, t, g, unknown or other
  misc_feature (567)..(567): n is a, c, g, or t
tcagcgtgtctctacacgaccggtgctcgatttagatagatagacgaggggggggtctcaggagcagcgctcgtcgggacgtctccaccagtggcctgggctctgctacttcctcaccctcctcactcgaggcacgagggtcgtcggccagtctcgcctgactnacgcctgcctccgtgtcgtggtctccgtggacagtcgactcaccatcctccgtgaccacgtcggaaacccactcgtagacgttcgtacgtagttaaataatactcttaccgtacgtagtactacgaaaacaactacccgaagtaccaaaccgtaccctaaagtactactacgtaatttagngttaacgtctactaacttaacggccgttacttacggtacggtttaccaacgttccgtnttaccgtcgttacgaccgttacgaacgtttggaccggaacacgacccgggtttacccnccgtaacggtaaacctacgtttccggaccggttcgtaacccggtcggtacggtagttaacggaacgacggacgtacgttactaagttacgtacttagactaaccgntaaacgtattaagaccgtaagccgtaaacgacgtacgtacgttaacgttacgggttaccggttaacgggacggtaacgaaccggtaagttaccgtacgtaacccgggtcgtaacggtaaccgaccggacctaaacgggttcccgaccgttccccgtagttacccg

SEQ ID NO: 151094 - DNA, 646 bp, Homo sapiens
  misc_feature: GYAE6OF01BEMRJ.7.5.A05.1.454.CMB.1.raw
tcagcgtgtctctacacgaccggtgctcgatttagatagatagacgagggggggggtctcaggaggcagcgctctcgggacgtctccaccagtggcctgggctctgctattcctcaccctctcactcgagggcacgagggtcgtcgggcccagtctgccctgactcagcctgcctccgtgtcgtgggtctccgtggacagtcgatcaccatctcctgcacgtacggaaccaccacgtgaccgttgacttaggttaactaaatctcgtctcgtgtactacaacaactaccgaggacaaaccgacccctaaagtcatctatttatgtatgtactatacgtcgtacgttagtacggttacagtcgtcttctcgtcgactacgtagtcgtcggacaccgaccgtccctccgtacgactctcgtcggtacggtcctacgaggtactaggagacggagtctagtattacgtacgagactcgtctaactacgtacgtacgacgacacgaccgaacgtccgtacgttacggttacgggttaccgggacgggtaaccggacgaacggtcccgtacggtaaccgttccggtaaccggtccgaaacccgggtcccggaaacggttccccggtaccccgtacccccgttcggtacccg

SEQ ID NO: 151095 - DNA, 706 bp, Homo sapiens
  misc_feature: GYAE6OF01EO5DV.7.5.A05.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctcctggacagtcgatcacntctcctgcacgtcggaaccnccactgacgttgcttaggttaataaatntctcttcctggtactacaacaactaccagacaacgaccccaagtcatnatttangntgtctagtactcgaccttgtcgggttactaatcgtcttcttcgtgtcctaccgtaagtcgtcggaccggtaaccnccgggtcccttaccgtacggtaaccctacgttccgttcggttcgggtccttacccgaacgtcggtacgaagtagtacggtaacgtcgtaagttactttagtactacgactacgtacgtactagtaacgttaacgacggtgtaacgcgaacgtacgtaccgttaccggttaacggggttttaccggaccggggtaacggtacccggtaaccggtccgttaccgggtacccgggtttacccgttaaccgggtaacccgggtaaccggttaaccccccggtaaccgggttaccccgttaccccgggtccccccggtttaaccccggg

SEQ ID NO: 151096 - DNA, 919 bp, Homo sapiens
  misc_feature: GYAE6OF01DBG2T.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacgaggggggggtctcaggaggcagcgctcgtcgggacgtctccaccatggcctgggctctgctattcctccaccctcctcactcgaggcacagggtcgtcggccagtctgccctgactcagcctgcctcgtgtcgtgggtcctccgtggacncgtcgatcaaccatcctcctgccaccgtcggaaacccaccgacgtggtaccgttaggtccgttaaggttaaataaacttacgtccttccttaccgtaggttaactaccaaacctaaaccgtaccaacggaccaaaaccgtacccccaagtcctactacgttaatttacgtacgtacgttagttaaccttagttaaacgtcccgggttaacctttaccggttaacggggtttacccacggtttaccggttcctttacgtccgttacggtacccgtaacgtaccggttacgcggtaaccgacccggtaaccccgtccccgtttacccgaaccgtaccgttcgttcccgttccggttaccggggtacccctaaccgggtccggtaacgtaaacgggtaacccggtcgggtaacgttacccgttggtttaaacttacccgtttaaacggcgaaccgtacgtttccgaaaccgtttataaccggttaacggacggtacgtaaccggtaccgtaccggttcccgtttaaaccgggttaccggggtttaccggggtttccgggggaaacccgggttaaacccgggtaaaccgggtacggtaccccgggttaacccgggttaacccccggttaccgggttaacccgggttaaccgggaaacccccggttaacccgggaacccggtttccccgggtacccccccggttccccggttaaccgggttaaccccg

SEQ ID NO: 151097 - DNA, 699 bp, Homo sapiens
  misc_feature: GYAE6OF01C1IFO.7.5.A05.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtcggcccagtctcgccctgactcacgcctgcctccgtgtccgtgggtctcctggactagtcgactcaaccntctccngacactcggaacccacactggacgttcgacgttagttaataactnttcctcgttctagtactacaacgtaactaccgaggaaccaacgtaccccgtaagtctaatactatttactagtactcggttactaacttacgtacggtactttacgtacgggttacctaacgttcgtctttccgtcgtacgtacgttactacggttcgtacggacgaccgtacccggtcctccgtacgtactagttcccgtacgtcggtcctacgtacgacgtaggacgtaacgtcggtactagtactttaacgtacgtacgactacgtacgtacgtaacgtaactacgtaacgtcgaaccggtactacgtaccgtacccgtttagggttaccgggtttcggggaccggtaaccggtaaccgacggtccgtaccggtccgtaccggtcgtaccggaccgtacccgtacggtcccgtacccgccccgttcgtacccg

SEQ ID NO: 151098 - DNA, 678 bp, Homo sapiens
  misc_feature: GYAE6OF01A54N0.7.5.A05.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtcgggcccagtctgccctgactcagcctgcctccgtgtctgggtcctcgtggacagtcgatcacatcctcngcactgaaccaccactgtacgttgcgttagttaataaatntctctctgtatacaacaactacccgaaggaccaaaccgacccctaaagtcactactaagttatggatgttactaagtagtccggtaccttaggtacgggttacaacgttcgtccttcgtcgtcggtactacgtagtcgtcgaccgaccgtacccggtaccccttccgtacgaaccctcgttccgtccggtacggtcccgtccggacgtacgtaacggaacggtacgggtacggtacgttacgttatttaccgttacgtccgtactacgtactataactacgtacgaacgtccacgacacgtactacgttacggttacgggttccggacgggtaacggaaccgtacggtacctaccgggtacccgtcgtaccggtacgaacccggtacccgtaacggtccccgtacccgtccccggtcgttaccccg

SEQ ID NO: 151099 - DNA, 679 bp, Homo sapiens
  misc_feature: GYAE6OF01A9NLI.7.5.A05.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttncttggttaanaatntctctctgtatcaacaactaccagaccaaacgcccccaaagtcactactactttatagtatgttactaattaacgtccggtaccttcgtacgggtttaccaatccgtcttccgtcgtcgtacctccgtaacgtccgtaggccgtacgaccggtccctacccgtcgaccgtacttcgtcgtcggcctccgaggtacgtagaacgtacggacgtcgtagtactttacgtactcgtactcgtacctactaccttaagtaaccgacggaccgacgtaccgacgtacccgtaaccggttacggtaccgggtttaccggggacgggtaaccgggtaacccgtaaccggtcggtaccgtaaccccgggttacccgtaggtacccgtaccgggtaccccgaacggtccccgtccccggttcccccggtcggttaccccg

SEQ ID NO: 151100 - DNA, 716 bp, Homo sapiens
  misc_feature: GYAE6OF01ARWFZ.7.5.A05.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgactcagcctgcctccgtgtctggtctcctggacagtcgatcaccntcctcctgcacgtcggaaacccaccactggaccgttgccgttaggttaaataaaatntcctcctccgttggtaactacaaactaactacccgaggaccaaacgaccccaaagtcatactattatatatgtctaattactcggtacctttggtacgggttacctaagtcgtacttcctactcgcctacgtagtcgtacggcgaccgtaccggtccctcccgtacgaaccctcttaccgttcggtccgggtccttacccgaagggtaccgttaacggaacgacggtaacggtacgttagtaacgtttaccttactcgacgtaaccgtctaccgtaattaacgtaccgtaaggactaacggcgacgtaccgtacttacgggttaacgggtttccggggacggtaaaccgggaaccgtaacgggttcccgtaccggtacccggtttccggaacggttacccggaaccggtacccgtaccggtaccccgtcccggtccccccgttgggtaacccccg

SEQ ID NO: 151101 - DNA, 648 bp, Homo sapiens
  misc_feature: GYAE6OF01B7CAT.7.5.A05.1.454.CMB.1.raw
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctccgtgacagtcgatcaccatctcctgcacgtaggaacccacactgaccgttgctggttaataaattactctctcctagtactacaacaactaccgagacaacgacccctaagtcattctatttantagttntatataactcggtcttcggtacggttaccagtccgtcttctcgtcgactctagtacgtcggacaccgaccggtcctcccgtacacccgtactccgttacggtcgggtccctaccggtacggtcgtaaggaaacgtcgggacggtactaggtaactttagttccgtcggactacgtaccttataatacgtaacgacggactaccgacgtactacccgtacgttacggttacggggttccgggacgggaaccggtaccgcgtaaccgtcgtacccggtaccgtacggtacccgaccgtaccgtacgtacccgtccccgtccccgtcggtacccc

SEQ ID NO: 151102 - DNA, 733 bp, Homo sapiens
  misc_feature: GYAE6OF01D8T6P.7.5.A05.1.454.CMB.1.raw
  modified_base (122)..(122): a, c, t, g, unknown or other
  misc_feature (122)..(122): n is a, c, g, or t
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (211)..(211): a, c, t, g, unknown or other
  misc_feature (211)..(211): n is a, c, g, or t
  modified_base (501)..(501): a, c, t, g, unknown or other
  misc_feature (501)..(501): n is a, c, g, or t
tcagcgtgtctctacacgaccggtgctcgatttagatagatagacgagggggggggtctcgaggaggcagcgctcgtcgggacgtctcccaccagtggccgtgggctctgtctattcctccnccctcctcactcgaggcgacgagggtcgtcgggcccngttctcgccctgactcgngtcctcgccgtcgtgtcgtggtcctacgtgacgngtcactccactctcgtctacgcctacgtaccggaaccacctacgtgtaccgttgtacgttaggttaactaaacttctcctcttcgtagtaactaaccaactaacgaaccgacgaacgaaccgtccccaaagtcctaatacgttaattgtcgtattcggttaacgtacttaacggttcccgggttacctttaacgggtaccggttttaccacgttccttcgtttccgacgtcgtaccggtacttacgtcggaacggtaccgtaaccctcgggtaccctacgactaccgttntacccggttcggtaacggccttaccgggagtacgacgggtaacgtcggtacgttggtaacgttataacgttcgacgtactaccggtatttaacacggtacgtaaggcggaacccgaagccggttaacgtacccgtgttacggtttaggggtaccggaccgggtaagacccgtaggtcccgttaaacgggcttacggacgtcacgtccgagtcccggtactcgggcgtacccg

SEQ ID NO: 151103 - DNA, 684 bp, Homo sapiens
  misc_feature: GYAE6OF01C565W.7.5.A05.1.454.CMB.1.raw
  modified_base (322)..(322): a, c, t, g, unknown or other
  misc_feature (322)..(322): n is a, c, g, or t
  modified_base (669)..(669): a, c, t, g, unknown or other
  misc_feature (669)..(669): n is a, c, g, or t
tcagcgtgtctctacacgaccggtgctcgatttagatagatagacgagggggggggtctcaggaggcagcgctctcgggacgtctccaccatggcctgggctctgctattcctcaccccttcctcactcgagggcacgagggtcgtgggcccagtctgccctgactcagcctgtcctccgtgtcgtgggtctccgtggacagtcgatcaccatctcctgcacgtacgaacccacacgtgacgttgtcgttagttaataatactctccttcgtgtacacaacaactaccgacggacaaccgtacccaagtcatactattagtntatcgtatatacgtccgtaccgtttacggtacgggttactaacgtccgtcttacgtcgtacggtacctaccgtaggttccgtcgggtacccggacccggtaccccggtcccccttacccgtaccggttacctacttccggtaccggtcggtccgtaccgacggtacgtaaggacggaacgacggtacgtattagttaacttacgtgtactgtactactacgtaactaacgtaggtaacgacgtacaggtaccctacgttaccggttagggtttaccgggacgggacggtaaccgaggtccgtacgtacccgtcgtacgtacgaccgacggtaaccgcccggttcccncccgttccggtaccc

SEQ ID NO: 151104 - DNA, 664 bp, Homo sapiens
  misc_feature: GYAE6OF01C3NJK.7.5.A05.1.454.CMB.1.raw
  modified_base (225)..(225): a, c, t, g, unknown or other
  misc_feature (225)..(225): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacgaggggtcggtcgggcccaggtctcgccctgacctcacgcctggcctccgtgtcgtcgggtctccgtggacagtcgatcaccactctctncactcggaaccaccactgacgttgacttaggttaataatactcttactcctgtactacaaaccaactaccaagacaaaccgacccaatcatactattanatntntactatactcgtacttacgtacgggttactacgtcgtacttctctgcttacagttcggtacggactaccgtacccgtcccttccctacgtaccctacgttcccgtacgtaccggtcctacccggtacgacggtacgaacggacggtaagtacgttagttactttaacgttacggtacacgactctactactaacgtaacgacgacgagtacacgtctacggtcggttacgggtttcggaacgggaccggtacgaacggtcgttaccggtaccgttaccggtacggtaccgaaccggtaccgtacggacccgtcccggtcccggttcccggtaccc

SEQ ID NO: 151105 - DNA, 793 bp, Homo sapiens
  misc_feature: GYAE6OF01EZFD1.7.5.A05.1.454.CMB.1.raw
  modified_base (163)..(163): a, c, t, g, unknown or other
  misc_feature (163)..(163): n is a, c, g, or t
  modified_base (274)..(274): a, c, t, g, unknown or other
  misc_feature (274)..(274): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcaggcacgaggtcgtcgggcccagtctgccctgacctnagcctgcctccgtgtctggtctccgtgacagtcgactcgaccattcctccgtgtaccaaccgtcggaacccacccacgtcggtaccgttgtacttaggttaattaaacgtnttccttacgtccgttacggtaactacaaacctaacctaccgaacgaccaaaccggaaccccctaaagtactactactagtttatgtacgtgttactaacgtacgttaccggtcctttacggttacgggttaacctactacgtcttactccgtacgtccgttccgaaacggttccgtacggaccgtacccgtacccggtccccttcccgtacgtacccttaccgtccgttacggtaccggtccccgttacgtacggtacgtacgggaaaacggaccggtaacgacgttaacgtaactttacggttacgtccgtaccgttacgtacgttacaagttaacgacggtaacgaccggtaacaccgtacgtacgttaaccgtccgggtttaacgggtttccggggaccgggtaaccggaacctacccgggtaccgtacccggttaacggttaccccgtacggaaccccgtaccggtaacccggtacccgttaccgggcccccgttccccggtcggttaccccccg

SEQ ID NO: 151106 - DNA, 659 bp, Homo sapiens
  misc_feature: GYAE6OF01DLGSS.7.5.A05.1.454.CMB.1.raw
  modified_base (166)..(166): a, c, t, g, unknown or other
  misc_feature (166)..(166): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (336)..(336): a, c, t, g, unknown or other
  misc_feature (336)..(336): n is a, c, g, or t
  modified_base (526)..(526): a, c, t, g, unknown or other
  misc_feature (526)..(526): n is a, c, g, or t
  modified_base (565)..(565): a, c, t, g, unknown or other
  misc_feature (565)..(565): n is a, c, g, or t
  modified_base (635)..(635): a, c, t, g, unknown or other
  misc_feature (635)..(635): n is a, c, g, or t
tcagcgtgtctctacacgaccggtgctcgatttagatagatagacgaggggggggtctcgaggaggcagcgctcgtcgggacgtctccaccatggcctggctctgctattcctcaccctcctcactcagggcacaggggtcgtggccctagtctcgccctgactcngcctgcctccgtgtcgtcgggtctccgtaggactagtcgaactccaaccnctctcctgccacgtacggaaaccncctacgtgacgttgacgttagtaaactaatactctccttcgtaggtactacaacgactaccgaggacaaccgtacccaagtcattctattagtatntacgtactagtacgtccgtacgtttacggtacggttacacttcgtacttcgtcgtacgtcctacgacgtacgtcggaccgtaccgtacccgtccttaccggtacaccgttcgtcggttcccggtacgtaccgacggtacgtaccgtaacggaacgggtacggtacgtacgttaagttactttacggtacncgtacagtactacctagtaacgaacgcgtaacgctacgngtactacggttggtacgggtccgaggaccgcgtacgtccgacggtaactccggacgccgaacgccgtacnccccgtccggcccgtccgtacccg

SEQ ID NO: 151107 - DNA, 642 bp, Homo sapiens
  misc_feature: GYAE6OF01A0LFP.7.5.A05.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (389)..(389): a, c, t, g, unknown or other
  misc_feature (389)..(389): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcgagggcacgagggtcgtgggcccagtctgccctgactcagcctgcctcggtgtcgtgggtctcgtggacnggtcatccacctntcctctgcactacgaaccncactgtacgtgcgtagttaanaatntctctcgtggtactacaacaactaccagaccaaccaccctaatcatctattatgattgtctaatacgtccggtcttcggtacgggttacacgtcgtctctcgtcgctaccaagtctcggctaccgccggtcccnccgtacgacctactcgtcggtcggccttaccggacggtcgtacggaacggacggtacggtactagttacttacttacgcgtacagtctaacgtaactacgtacggacgacggaacgtacgaccgtactacgttaccggttaggggtttaccgggaccgggtacggaaccgtacggtactacccggtaccggttaccggtacggtccgacggacccgtccggtaccctcccgggtccccggttccgtaccccgg

SEQ ID NO: 151108 - DNA, 805 bp, Homo sapiens
  misc_feature: GYAE6OF01DG2NZ.7.5.A05.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (774)..(774): a, c, t, g, unknown or other
  misc_feature (774)..(774): n is a, c, g, or t
tcagcgtgtctctacacgaccggtgctcgatttagatagatagacgaggggggggtctcaggaggcagcgctctcgggacgtctccaccatggcctggctctgctattcctcaccctcctcactcacgggcacgagggtcgtggccagttctcgccctgactcagcctgcctcgtgttctggtctccgtgganacggtcactccacctacgtccttccnggaccacgttcggaacccacgtacttgaccgttnacttaggttaataatacttctacgtccgtaggtactacaacctaacgtacccaggaaccgaaaccgtacccctaaatcgtactactaagttttatacgtacgtacttacgttaagttaaccgtccggttacgttttaccggtacgggttttacctaacgttccggttacttttccgttccgttacggtacccggttaacgtaacggttccgtttaaccggggtaccgaaccccgtacccgggtccccttaacccggtccgtaacccttaactttccggtaccggtacggttcccgtaccgtaacggtccggtaaggaacggtacggtacgggtcttaacgttactttatacccgttacgtacccgtagtactttacgaaccggtttagaaaccgtccggaaacgacgtaccgactaaccggttacgttaccgggtacggggttttcggaaccggggttacgaacgtaacggtcccgttacggtacccggtttacgcggttaccgaacccgtcccggttaancccggtccccggttcccggttcctaccccgg

SEQ ID NO: 151109 - DNA, 675 bp, Homo sapiens
  misc_feature: GYAE6OF01BSEXP.7.5.A05.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
tcagcgtgtctctacacgaccggtgctcgatttagatagatagacgaggggggggtctcaggaggcagcgctctcgggacgtctccaccatggcctgggctctgctattcctccaccctcctcactcagggcacgagggtcgtgggcccagtctgccctgactcacgcctgcctccgtgtcgtcgggtctccgtggaccagtcgatcacctntctctgcaactcgaaccacnctgacgttgctagttaataaatnttcctctcctagtactacaacaactaccagaccaaaccgacccctaaagtcactctatttactagtattgtactaatacgtccggtccttacggttacgggtttaccaagttccgtacttcgtacgtcggtcctacgtacgtcgtacggaccgacgacccgtccctacctacgaccgtacttcgtacggtcggtcccgacgtacggtacgtacggaagacggtagtccgtttaagttaacttacgttacgtacgcgtaacgtctacgtaatacgtaacgtagtaccacgtacacgtaccgttacgtacgggttacgggtttcccgggaagggtaaccggaaccgtacggtaccggtcgtaccggtaccgttcggtaacacccgtaaccggacggtcccgacccgtccccggtgtaccccg

SEQ ID NO: 151110 - DNA, 915 bp, Homo sapiens
  misc_feature: GYAE6OF01DMPSD.7.5.A05.1.454.CMB.1.raw
  modified_base (240)..(240): a, c, t, g, unknown or other
  misc_feature (240)..(240): n is a, c, g, or t
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtcgtgggtctcctggacagtcgatcacctatcctcctgccactaggaacccactacgtgacgttncgtagttaataatctctactccgtaggtactacaactaacgtaccaggaccaaaccgacccccgtaaagtcctaattacctaatttatcgtattacgttacttaataacggtccggtaccttttacggaacgggttttaccaaacgttccgtactttccgtcgttacggtaccctaaccctaaggttccgtacgggtacccggaacccgtacccggtcccgttaccccggtaacgtaaccccgttaacgtttccccgtaccgggttaccggggtaccccttaacccgggtaacggggttacccgtaaacggggtaaaaccgggtaaccgggtaaacggggttaaccgtttaaccgggttaaacgtttttaaccggttttaaccggttaccgggtaacccgtttaacggttacccgtttaacgtaacgtttaaaccgtaaaccgggtaccgggaaccgttaaccgggaacttaccgggaaccgttaaccggtttaccggttaacggggttttaacccggggacggggtaaacccgggtaaaccgggtacggtacccggtaacccgggttaacccgggtttcccgggtaaaccggttacccgtaacccggggtaaccccgtaacccgggggtttaccccgtacccccgggttacccccccgggtgtttaacccccgg

SEQ ID NO: 151111 - DNA, 756 bp, Homo sapiens
  misc_feature: GYAE6OF01DC5E4.7.5.A05.1.454.CMB.1.raw
  modified_base (500)..(500): a, c, t, g, unknown or other
  misc_feature (500)..(500): n is a, c, g, or t
  modified_base (641)..(641): a, c, t, g, unknown or other
  misc_feature (641)..(641): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgaggcacgagggtcgtcgggacccagtctcgaccctgacctacagccctgccctccgttgtcgtgggtacctccgtaggacaggtcactccaaccgacttccgtcctcgccacgtaccggaaacccacctactcggtacgttgtacgttaagtaaataattctctcctcgtagtacacgaaaccaaacctaccgaaacggtaaccaaaacccgaacccctaaacgttctaacttacttaactttaagtacgtacgtacgttactaacgttaacggttccggttaccgtttaacggttacggtttaccctaacgttcgttccttccggttactccgtaccgtaccgtaacgtccgtacggccctacggtaccccncccgttaccacgtacctcttccggttaccgtcggtaccgaccgtacgggacaacgggaacggtacgtacggttatacgttactttacgtacgaccggtccttaacgactaactagtaacgcggacggtactaacgcgaacnccgtttacgtaccgggtaacgggttccgggaacggtaccgacgtacgtcccggtaggttacccgtggaaaccgtcccaaacggtcccgcgtacccgtcccggccgttactacccg

SEQ ID NO: 151112 - DNA, 704 bp, Homo sapiens
  misc_feature: GYAE6OF01COZ7K.7.5.A05.1.454.CMB.1.raw
  modified_base (113)..(113): a, c, t, g, unknown or other
  misc_feature (113)..(113): n is a, c, g, or t
  modified_base (154)..(154): a, c, t, g, unknown or other
  misc_feature (154)..(154): n is a, c, g, or t
  modified_base (237)..(237): a, c, t, g, unknown or other
  misc_feature (237)..(237): n is a, c, g, or t
  modified_base (693)..(693): a, c, t, g, unknown or other
  misc_feature (693)..(693): n is a, c, g, or t
tcagcgtgtctctacacgaccggtgctcgatttagatagatagacgaggggggggtctcaggaggcagcgctcgtcgggacgtctccaccatggcctgggctctgctattccncaccctcctcactcgagggcacaggggtcgtggcccagtcncgccctgactcacgcctgccgtcgtgtcgtggtctccgaggacaggtcatccaccatcctactcgactaccgtcggaaacccnccgtagtacgtaccggttggtaccgttagttaactaatccgttccttccgttaccggttagtactaactaaacaaccgtaacccgaaggaaccgaaaccgtacccctaaagtacctacttaaccgttagtttacaggtaacttgttaaccctaagtttaacgtcccggttacttacggttaacgggttacctacgtaccgttcttccgtacggtacgtactacgtaacgttcgacgggtaccaacgtccccggtccctacctaccgtaccttcgtcgtaccgtcggtccctacggacggtacgtacgaacggtcgtacggtcgtacgttaagttactaacgtcgtacgactcgtactaagttacgacgacgtaacgcgcaacgtcgcgttcgtacgggtcgacggacgacgacgtccgagtacccgtgtacgacgtacgccgtacgcccgtacccncggtcctaccg

SEQ ID NO: 151113 - DNA, 735 bp, Homo sapiens
  misc_feature: GYAE6OF01C5KM9.7.5.A05.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (330)..(330): a, c, t, g, unknown or other
  misc_feature (330)..(330): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtcgtggtctcgtggaccngtcancacgactctcctgcacgtcggaaccncctactgtacgttgcgttagttaataaattntccttccttcgtgtaactacaaacctaacgtaccaaggaccaaacccgacccgaagtctaatccttaatttagngtattacgtactaatacgttccgtaccgtttacggttacggttacaacgttctaccgttctcgtcgtccttaacgtacggttcgacggtacccgaaccggtcccctcccgtaacccgttacgacttaccggttcgtccggttacgtcccgccgtagggaccttaacgggaacggtaccggtagtacgttagtttataaccgtttacgcgtactacgtcaacttagttaacgacgagtacgactaccgacgtacgtttacgttccgggttagggtacccgggtaacggtaccgggaaccgttacggaccgttacccggtaaccggttaaccgttaccgggacccaacccgggtcctaacccggggttcccgttacccccgcccgttttaaaccgggttaccccccg

SEQ ID NO: 151114 - DNA, 634 bp, Homo sapiens
  misc_feature: GYAE6OF01B54BB.7.5.A05.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
  modified_base (513)..(513): a, c, t, g, unknown or other
  misc_feature (513)..(513): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgagggcacgagggtcgtgggcccagtctgccctgctcngcctgcctccgtgtctgggtctccgtaggacngtcgatcacctatctcctgcacgtcggaacccacctactggtacgttgacttaggttaataaatctctcgtactggtactacaacaactaccagacaacgcccaagtcatctagttatgtatgtactagtactccggtaccgttcgtacgggttacaccgtcgtcttacctcgtgcctaccgagtcgtcggacgaccgaccgtcctccgtacgactctcgtccgtacggccgtaccgaaggtccgtagaacggtacggaaggtcgtagttactttacgttacgtctacgatcctaactataacgtacgagcggaacncgtacgaccgttacgtacgggttacggttacgggacggtaaccgacggtacgtccgtacgggtaaccttccgggactaccggcggtacccggacgtacccgtccccgtcccggtgtacccg

SEQ ID NO: 151115 - DNA, 791 bp, Homo sapiens
  misc_feature: GYAE6OF01EJJIU.7.5.A05.1.454.CMB.1.raw
  modified_base (194)..(194): a, c, t, g, unknown or other
  misc_feature (194)..(194): n is a, c, g, or t
tcagcgtgtctctacacgaccggtgctcgatttagatagatagacgaggggggggtctcaggaggcagcgctctcgggacgtctccaccatggcctgggctctgctattcctcacccctcctcactcgaggcacgagggtcgtgggcccagtctgccctgactcagcctgcctcgtgtcgtggtctcgtagacngtcgatcactatcctcctgactaacgtacggaacccaccgtagtacgtacgtttcgtacgttaggttttaaactaaaattacttccgttccgttaccgttacggttaactaaccgaaaacctaaacctaacccgaggaacccgaaaaccgtacccccctaaaagtcctaacttacgtaattttaagtagtacttacgttactaaacgttaccgttacccggttacctttacgggttacgggttttaccctaacgttcgttacgttcctacgttcgtaccttaccgtaacgtcgtcggaccgacgtacccgtccgtaccgtcgtactacgttcgtacgtcggtcctacggcgtacgtaggacgacggtcgtcgtagttacgtttactacgtcgacgtacgtctaactaactacgtacgacgtacgtacgaccgtacggaccttaacggttccgggtttacgggttacccgggggaacggttaacgggaacccgtaacggtacccgttacccgggtaacccggttacgtaacccgggttaccgaaccccggtacccggtacggtccccggttaccccggttcccgtccggttaaccccg

SEQ ID NO: 151116 - DNA, 698 bp, Homo sapiens
  misc_feature: GYAE6OF01CB6EP.7.5.A05.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctcgccctgactcagcctgcctccgtgtcgtgggtctcgtgacngtcactcacntctctgcacgtcgaacccacctcgtagaccgttgcgttaggttaaataatcttctcctcttggtactaacaactaactaccgaacggaacctaaaccgaccccctaagtcaacttacgtaacttttancgtattacgttacttaacgtaacgtccggttccgttacggttaacgggtttcctaacgttccgttacctttcgtcgtcgtcctacctacggttcgnggaccgacgacccgtccctacccgtacaccgtctcgttccgggcggtaccctaccggtaggtcgtacggaacggtacggacgttacttgttaacttagttcacgcacgtccttactaaagtcacgacgactcgaacgtcgtacgtaccggttcggtttaccgggttacgggcggaacccggaacgtaccgtcggtaacccgtcccgggttacgaacgtcccggtaaccgaccgggactcccccgccgggttaccccgtcgttaccccg

SEQ ID NO: 151117 - DNA, 649 bp, Homo sapiens
  misc_feature: GYAE6OF01BDIKF.7.5.A05.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
tcagcgtgtctctacacgaccggtgctcgatttagatagatagacgaggggggggtctcaggaggcagcgctctcgggacgtctccgaccatggcctgggctctgctattcctcaccctcctcactcgaggcacagggtcgtcgggccagtctgccctgactcagcctgccgtcgtgtctcggtctccgtggacngtcgatcacctntctcgtgaccacgtacgaacccncgtatgacgttgtactaggttaataaagtcttcgtcttcgtagtactaccaactaacgtaccgacgaaccaaccgaccctaagtctactactattatcgtatcgttactagtaccgtcggtcgttacggtacggttaccacgttcgtcttcgcgtcgtacgtacgtagtcgacggtcgtaccgtccgtcctccgtacgacctacgtccgtacggtcggtacctaccgtgtacgtaggacggacgtcggtacttagttacgttacgtcgtcgactagtctactaagtacgcgagacgcgtacgtacgtacgtacgttcgggttacgggtaccggacgggtaccgacgtacggtaccgttaccgtacggtaccgaccgacgaccggtccgtacccggtacccggtcccgtacccgtgtccc

SEQ ID NO: 151118 - DNA, 721 bp, Homo sapiens
  misc_feature: GYAE6OF01ATZ98.7.5.A05.1.454.CMB.1.raw
  modified_base (534)..(534): a, c, t, g, unknown or other
  misc_feature (534)..(534): n is a, c, g, or t
tcagcgtgtctctacacgaccggtgctcgatttagatagatagacaggggggggtacgtcgaggaggcagcgctctcgggacgtctccaccatggcctgggctctgctattccctccaccctcctcactcgagggcacgagggtcgtgggcccagtcctgccctgactcagcctgcctccgtgtcgtcgggtcctccgtcggacgagtcgacgtccaaccgatcctaccctgcctacgtcggaaccctacgacgtggaccgtttggccttaaggttaaataattagtccttacgttccgtacgtaactaacaaacaaccgtaccgacggaacccgaaacccgacccgtaagtacatacttaagttagtagtacttacgttacgtaacgtacggtcccggttaccgttacgggttaacgggttacctacgtccgtacgttcgtcgtcgtcctacgtacgtccgacggaccgaccgtaccgtaccgtaccgtacgacctacgtcgtcgaccgtccgtacgacgtacgaacgacggnggtacgtacgtagtacgttagtcgtacgacgtactctataactaacgtacgagacgacgtacgacgttcgtacggttacggttacggggtacgggacgggaccggaacgtaccgtaccggtacggtaccgtaccggtacgaccggtaccggtacccgaccggtcccgtcccggtcccgtccggtccg

SEQ ID NO: 151119 - DNA, 744 bp, Homo sapiens
  misc_feature: GYAE6OF01DSEHB.7.5.A05.1.454.CMB.1.raw
  modified_base (192)..(192): a, c, t, g, unknown or other
  misc_feature (192)..(192): n is a, c, g, or t
  modified_base (316)..(316): a, c, t, g, unknown or other
  misc_feature (316)..(316): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtggcccagtctgccctgactcagcctgcctcgtgtctgggtctccgtggacngtcgatcaccatctcctagctaccgtggaacccaccactggacgttgcgttaggttaataacgtctctctccgtggtatacaacaactacccgagaccaaacgaccccaaagtcatctattacngtatgtctaatagtcgtctttcgtacgggtttcaacgtcgtcttctcgtcggtactacgaacgttccgtaggtccgaccgtaccggtccctaccctcggtaaccctctccgtcgtcgggtaccctccggacggtacgtacgaacggacggtacgggtaccgtaagttaacgtttacgttaacgttacgtacgtacgttaccttacgtaacgttaacgtaaccgggtacggtaaccgacgtaccgaaccgtaccgttaacccggttccgggttacggggtttttaccgggacggggtaaaccggggtacccgtaaacgggttcccggtaccgggttaaccccggtaccggtttaacggggtaccccgaaacggtaccccggtaaccggtccccggttacccgtaccccccggttcgggtttaacccccg

SEQ ID NO: 151120 - DNA, 829 bp, Homo sapiens
  misc_feature: GYAE6OF01B68DI.7.5.A05.1.454.CMB.1.raw
  modified_base (359)..(359): a, c, t, g, unknown or other
  misc_feature (359)..(359): n is a, c, g, or t
tcagcgtgtctctacacgaccggtgctcgatttagatagatagacgaggggggggtctcaggaggcagcgctctcgggacgtctccaccatggcctgggctctgctattcctccaccctcctcactcgagggcacgagggtcgtcgggcccacgttcgtcgccccttgtacctcgacgcccgtcgtccccgttccggtgttcgtcgggtcctccgtaggactacgttcgactaccacctactcctcctcgacctacgtaccggaacccaccgtactcgtacgttcgtcgttagtaataatactctctcgtagtacacaacaacgtaccgacgtaaccgaaccaaccctaagtctaactnttaactttatggtaactcgttaacttaacgtacggttacccgtacggtttaccggttaacggtttaccacgttacccctttacgttccgtcggtaccggtaccgttaacccgtaggttccgggtaaccgggtcccgtaacccggttcccgtaccccgttacccggtaaccacccgttaacgttccggttaccgggtcgggtacccgttaccgggagttaaccggtaacgggaaaaccggacggggttaacgttacgttaaacggtttaaacgttttacgttacccgtaggtaccgttaactaccgttaattaaaccggtactaaaccgggtaacaccgtagaccttacgacgtttaccggtagggtttacggaccgggtacggacggttaaacgaccgtaccggtacgtacccgtcgtaccggacaccggtaccgaccggttacccgcccgtacccgttccggtaccccg

SEQ ID NO: 151121 - DNA, 838 bp, Homo sapiens
  misc_feature: GYAE6OF01E20HJ.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctccaccctcctcactcagggcacgagggtcggtgggcccagtctcgccctgactcagcctgcctccgtgtcgtgggtcctccgtgacgagtcatcactatctcctgcactcgaaccactctgtacgttgcgtagttaataatcttctctcgtaggtatacaactaactacccaggaaccaaaccgaccccgtaaagtactagttacttaagtttatagtatgttacgttaagtaaccgttccgtacccgttttacgggttaccgggtttaccgtaacgtccgttcctccgtttcgtccggtaccttaccgtaacgtacgtacggcccgaaccgacccggtccttcccgtacgtacccgttcttacgtaccgtccgggtaccctcggaccgggtacgtaacggaacggtacgggtaacgtcgttaacgtttatttaaccggttaccttacggaccttacggacttaaccttagttaaaccgcggttaacggaaccggagtaacccgtactaacccggttacgttttaccccgggtttaagggggtttcccccggggaaacgggtacccgggtaaacccggtaaaccgggttccgaccccggggttaacccggtttaaccccggttaccggggtaaccccgggttaaaccccgggcccccgggtaaaccccggtttaccccgggtcccccccgggtttacccccgggtaaccgtttaacccccccggg

SEQ ID NO: 151122 - DNA, 813 bp, Homo sapiens
  misc_feature: GYAE6OF01A5SHF.7.5.A05.1.454.CMB.1.raw
  modified_base (208)..(208): a, c, t, g, unknown or other
  misc_feature (208)..(208): n is a, c, g, or t
  modified_base (322)..(322): a, c, t, g, unknown or other
  misc_feature (322)..(322): n is a, c, g, or t
tcagcgtgtctctacacgaccggtgctcgatttagatagatagacgagggggggggtctcaggaggcagcgctctcggggacgtctccaccatggcctgggctctgctattcctcaccctcctcactcagggcacaggggtcgtgggcccagtctgccctgactcagcctgcctccgtgtctgggtctccgtggacagtcgatcaccnttctcctgcacgtcggaacccaccactggacgttgcgttaggttaataaatctctctcgtgtactacaacaactacccgagaccaaaccgaccccaaagtcaactctaatttangtattcgtacttaagttaacgtccggtcccgtttacggtacggggttttacccaacgttccgttccgtttccgttaccgttcggtaccttaccgtaacggttcgtacgggaccgtaccgtacccggtccccgttacccgtacgtaccctaccgttcgtccggtccgggtacctcccggtaaggtaccgtaagggaaacggtaccgggtaacggttcgttaacgttaacgttttaacgttacggtaccgacgtaaccgttacttacctaaacgttacgtaaccggaacggtaacgacggtaaccgtacggtaccgttaaccggttaccggttaaccgggggtttaccggggacccgggggtaaaccgggtaaccggtaaccgggtaccgttacccgggaacccggggttttcccggaaccgggttacccgaaccccgggtacccggtaccgggtacccccgttccccgggtaccccccgttgggttaccccc

SEQ ID NO: 151123 - DNA, 768 bp, Homo sapiens
  misc_feature: GYAE6OF01A61IB.7.5.A05.1.454.CMB.1.raw
  modified_base (173)..(173): a, c, t, g, unknown or other
  misc_feature (173)..(173): n is a, c, g, or t
  modified_base (664)..(664): a, c, t, g, unknown or other
  misc_feature (664)..(664): n is a, c, g, or t
  modified_base (674)..(674): a, c, t, g, unknown or other
  misc_feature (674)..(674): n is a, c, g, or t
  modified_base (743)..(743): a, c, t, g, unknown or other
  misc_feature (743)..(743): n is a, c, g, or t
  modified_base (751)..(751): a, c, t, g, unknown or other
  misc_feature (751)..(751): n is a, c, g, or t
tcagcgtgtctctacacgaccggtgctcgatttagatagatagacgaggggggggtctcagggaggcagcgctcgtcgggacgtctccaccatggcctgggctctgctattcctccaccctcctcactcgagggcaacaggggtcgtcgggcccagtctcgaccctgactacngcctgccctcgtgtcgtgggtccttccgtgggactacggtcgactccaaccattccgtccgtagacctaccggttaccggaaaccctaccgtaacgttcggaaccggttcggtactttaaggttaaattaaaaacttccgttttccgttccctttaacccgttacggggtttaaccaaaccggtaaacctaaaccgttaaaccccgtaacggggacctaaaaaccgaaccccccgtaaaaggtcctaactttaaccgtattttaacgtaacggtaacttcggttaacttaacgtaacgtttccggtcggttaacgtttacgggtacctaacgttccgtacttcgtacgtcgtctacgacgtcgtcggacaacgtccgcctccgagtaccagttcgtcgtcgtcctcggacggtacgtacgtaaggaccgacggtgtataacttcgtaacgtcgtagtccacgtactaagtcgtaaacggtcggaacgtacncggttaacgngtaccgttacgggtacggttcgggagtaccggacgacgcgtacgtcctacggaccgtacgaccgtaccnggtacccnccggtcccgaacggtcc

SEQ ID NO: 151124 - DNA, 811 bp, Homo sapiens
  misc_feature: GYAE6OF01AYOPF.7.5.A05.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgaggggtcgtgggcccagtctgccctgactcagcctgcctccgtgtctgggtctcctggacagtcgatcaaccntctcctgcactcggacccnccactggacgttgccgttaggttaactaaatcttccnctcctgtancaacactaccagaccaaacgccccaagtcatactattangattgtatagtactcgccgttcgtacgggttacacgttcgactttccgtacgtcggacctaccgaaggttccgtaggtacgtaccgtaacccggtcccttaccccgtacggtaaccccgtattcccgtacggtacgggtcccgtacccggtcgggtaccgtaacgggtaaacggtaaccgggtaacgggtacgttacggttaaacgttttacgttaaccggttacgtaccggttacggtacccttaacgtaaacgttaaacgttccggtaaaccgggacctaaccgggtacgtaaccgtaaccgtacccggtttaccggttaacggggggttttaccggggaacccgggggttacgggtaaacccggtaaacggtaccccggttacccgggttaaacccggtttccccgggttacggggtaaacccggaccccgggtaaccggggtaacccggttccccgggacccccgggttttccccgttacccgggttacccccgg

SEQ ID NO: 151125 - DNA, 838 bp, Homo sapiens
  misc_feature: GYAE6OF01A7VD8.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacaggggtcgtgggcccagtctgccctgactcagcctgcctccgtgtctgggtctccgtggacngtcgatcaccatcctcctgcactcggaaccaccactgacgttgcttaggttaataatatctctcctgtatcaacaataccaggacaaacgacccccaaagtcatctatttatcgtatgtactataagtcggtccttcgtacgggtttacctaattccgtcttcgtcgtcgtacctactaacgttcgtcgggccgaccgtaccgggtccccttccccgtacggtaacccctacgttacccgtccggttaccggggtcccttacccggtacgggtaccgtaacgggaaacgggtaaccgggaacgggtaccgtttaaggttaacgtttttaaacgttttaacccgttaggtacccgtaacggttaccctttacctaaatttaaccggttaaccgaaccggggttacccaacgggaacccgtaacggttacccttaaccggttaccgggttttaaccgggggtttttacccggggggaaccgggggtaaaccggggtaaaccccgttaacgggtacccggttaacccgggtacccccgggtttacccggttaaccggggtacccgtaacccgggtaacccccggttaaccgggtcccccggtttacccccgggtcccccccgggttacccgggtttaaccccccg

SEQ ID NO: 151126 - DNA, 741 bp, Homo sapiens
  misc_feature: GYAE6OF01APTCD.7.5.A05.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacgagggtcgtgggcccagtctgccctgacctcacgcctgcctccgtgtctcgggtctccgtggaccngtcgatccaccatcctcctggccacgtacggaacccacacgtgaccgttnacgttagttaataaactctctcctccgtggtactaccaaactaacttaccgacgacgaaaccgacccctaaatccattactatttatacgtattctacttaagtaacgtcggttacccgttacgttacggggtttacccaagttccgtacctttacctcgtacgtaccttacgaaacgttcgtacgggacgtaccggaacccgggttccctcccgttacgtaacccgtacgttaccgttaccgggttcggtacctaccggtaaccgtccgtaaaggttaacggaccgtaacgggcttaacggttaacttacgttaaccgtagccgtaacgtactacgtaacttaacgtacgacggacccgtagtacccgaagacccgttacgttacggttaaaccggttttcggggaaccgggtaggaacccgtaggtaccgtacgacccgttacggtacgtaccgaccgtacgaccgtccgtcccgcccgttcgtaccccg

SEQ ID NO: 151127 - DNA, 517 bp, Homo sapiens
  misc_feature: GYAE6OF02IYQJP.7.5.A05.1.454.CMB.1.raw
tcagcgtgtctctacacgaccggtgctcgatttagatagatagacaggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccccaaagtcatcatttatgatgtctataatcggccttcagggtttccaatcgcttctctggctccaagtctggcgacacggcctccctgaccatctctgggctccagctgaagacgaggctgattattactgctagctcatatacagcagctagcactctaggtttcggacggaggaccaaggctggaccgttccgtaaggtccaggacccgaaggaccgtcgtaccccctggtaccc

SEQ ID NO: 151128 - DNA, 536 bp, Homo sapiens
  misc_feature: GYAE6OF02HVI2D.7.5.A05.1.454.CMB.1.raw
  modified_base (421)..(421): a, c, t, g, unknown or other
  misc_feature (421)..(421): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccgaggctagaagacgaggctgattattactgcagctnatatacagcagcagcactcgtaggtttcggacggtacgggaccgaagcgtacggtacccggtccgtacgggtccgtacggacccgaaggtcccgtccggcccccgtcggtacccg

SEQ ID NO: 151129 - DNA, 500 bp, Homo sapiens
  misc_feature: GYAE6OF02GMRPZ.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacaggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttataaatatctctcctggtatcaacaatacccaggcaaagcccccaaagtcatcatttangatgtctataatcggcttcagggtttccaatcgcttctctggctcaagtctggcgacacggcctcctgaccatctctgggctccaggctgaagacgaggctgattattactgcagctcatatacaggcagcagcactctaggtttcgcggagggaccaagctacgaccgtcctaggtcagcccaaggcctcgcccctcggtcc

SEQ ID NO: 151130 - DNA, 522 bp, Homo sapiens
  misc_feature: GYAE6OF02HBEL5.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggacaaacgcccccaaagtcatctatttatgatgtactataatcgccttcgtagggtttccaatcgcttctctgctcaagtctggcgacacgcctccctgaccatctctgggcctccgaggctgaagacgaggctgattattactgcagctcatactacgaggcagcagctactcgtaggtttccgggacggacgggaccaaggcgtacggaccgtccgtaggtccacgcccgaaggcctcgccccgtggtccc

SEQ ID NO: 151131 - DNA, 503 bp, Homo sapiens
  misc_feature: GYAE6OF02GHKPI.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcattatgatgtctataatcggccttcaggggtttccaatcgcttctctggctcaagtctggcgacacggcctccctgaccatctctgggctccaggctgaagacgaggctgattattactgcagctcatataacaggcagcagcactcgaggtttcggcggaggacaagctgaccgtccgtagtcgacgccgaacggctcgcccctggtccc

SEQ ID NO: 151132 - DNA, 505 bp, Homo sapiens
  misc_feature: GYAE6OF02GEVDT.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctggctccaagtctggcgacacggcctccctgaccatctctgggctccagctagaagcgagctgattattactgcagctcatatacgaggcagcagcactcgaggtttcggcggaggaccaaggctacgaccgtcgtacggtcacgcccaaggcctcgccccgtcgtcc

SEQ ID NO: 151133 - DNA, 520 bp, Homo sapiens
  misc_feature: GYAE6OF02HH74R.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccccaaagtcatcatttatgatgtctataatcggccttcagggtttccaatcgcttctctggctcaagtctggcgacacggcctccctgaccatctctgggctccaggctgaagacgagctgattattactgcagctcatatacaggcagcagcactcaggtttcgcggagggaccaaggctacggaccgtccgtacggtaccgacgccccgaaaggccgtacgtcccccgtcggtacccg

SEQ ID NO: 151134 - DNA, 505 bp, Homo sapiens
  misc_feature: GYAE6OF02G0EPZ.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacggcctccctgaccatctctggctccaggctgaagacgaggctgattattactgcagctcatatacaggcagcagcactcgtaggtttcggcggagggaccagctagaccgtcctaggtcacgcccgaaggcctcgcccctggtccc

SEQ ID NO: 151135 - DNA, 519 bp, Homo sapiens
  misc_feature: GYAE6OF02IH82M.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcctttcaggggtttccaaatcgcttctctggctccaagtctggcgacacggcctccctgacccatctctgggctcaggctgaagacgaggctgattattactgcagctcatatacaggcagcagcactcagggttttcggcgggacggaccgagcgtcgaccgtccgtaggtcgacgacccgaaggcctcgccccctcggtaccc

SEQ ID NO: 151136 - DNA, 519 bp, Homo sapiens
  misc_feature: GYAE6OF02H70XI.7.5.A05.1.454.CMB.1.raw
  modified_base (451)..(451): a, c, t, g, unknown or other
  misc_feature (451)..(451): n is a, c, g, or t
tcagcgtgtctctacacgaccggtgctcgatttagatagatagacagggggggggtctcaggaggcagcgctctcgggacgtctccaccatggcctgggctctgctattcctcaccctctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgcttcagggtttccaatcgcttctctggctccaagtctggcgacacggcctccctgaccatctctggctccaggctagaagacgaggctagtattattactgcagctcatatacaggcagcagcactcgtagtttcgggnggacggacgaagcgtacgaccgtcgtacgtcgacgcccgaaggtcctaccggtcccccgtggtacccg

SEQ ID NO: 151137 - DNA, 548 bp, Homo sapiens
  misc_feature: GYAE6OF02HSF29.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaacgcccccaaagtcatcatttatgatgtctataatcggccttcagggtttccaatcgcttctctggctcaagtctggcgacacggcctcctcgaccatctcgtggcctccgaggctagaagacgagctgattattactgcagctacatatacaggcagcagcacgtcgtagggtttcggacgggtacgggaccgaacggccgtacggtacccggtccgttaacggtaccgacggacccgaacggccgttcccggcccccgttcgggtaccc

SEQ ID NO: 151138 - DNA, 500 bp, Homo sapiens
  misc_feature: GYAE6OF02I8WKU.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctgctcagtctggcacacgcctccctgaccatctcgtgggctccaggctagaagacgaggctgattattactgcagctcattatacaggcagcagcactcgtaggtttcggcggaggaccaggctgaccgtcctaggtcagccaaggctcgccccgtcgtcc

SEQ ID NO: 151139 - DNA, 492 bp, Homo sapiens
  misc_feature: GYAE6OF02HTGC7.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccagcaaagcccccaaagtcatcatttatgatgtctataatcggccttcagggtttccaatcgcttctctggctcaagtctggcgacacggcctccctgaccatctctggctcagctgagacgagctgattattactgcagctcatatacagcagcagcactcaggttttcgcggaggaccaagctgacgtcctagtcagcccaaggcctcgccccgtggtaccg

SEQ ID NO: 151140 - DNA, 518 bp, Homo sapiens
  misc_feature: GYAE6OF02FP8YP.7.5.A05.1.454.CMB.1.raw
  modified_base (299)..(299): a, c, t, g, unknown or other
  misc_feature (299)..(299): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcagggtttccaatcgcttctctggctccaagtctggcgacacggcctccctgaccatctctgggctccaggctgaagacgaggctgattattactgcagctcatatacaggtcagcagcactcgtaggttttcggcggagggaccaggctacgaccgtcctaggtcgacgcccgaaggcctcggcccccgtcggtacccg

SEQ ID NO: 151141 - DNA, 536 bp, Homo sapiens
  misc_feature: GYAE6OF02F1IIO.7.5.A05.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
tcagcgtgtctctacacgaccggtgctcgatttagatagatagacagggggggtctccaacggaggcacgcgctctcgggacgtcctcccaccatggcctgggctctgctattcctcaccctcctcactcagggcacagggtcgtgggcccagtctgccctgactcagcctgcctccgtgtctgggtcctccgtgggacagtcgatcaccatctcctgcactggaaccnccactgacgttgcctggttataaatntctctccgtggtatcaacaatacccaggtcaaagcccccaaagtcatcatttangatgtctataatcggccttgaggggtttccaatcgcttctctgctcagtctggcgacacggcctccctagaccatctctgggctccgaggctgaacgcgagctgatttatacgtagcagtctcatactaccaggcagtccagccacttcgtacggtttcggacggtagggacctagcgtacgaccggtcctacggtcacgtcccgaaggcctcggtcccctcggtcc

SEQ ID NO: 151142 - DNA, 497 bp, Homo sapiens
  misc_feature: GYAE6OF02G60MG.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcattatgatgtctataatcggccttcagggtttccaatcgcttctctgctcaagtctggcacacggcctccctgaccatctctggctccaggctgaagacgaggctgattattactgacagctcatatacagcagcagcactcaggtttcgcggaggaccaagctcgaccgtcctaggtcacgccaaggcctcgccccgtggtcc

SEQ ID NO: 151143 - DNA, 498 bp, Homo sapiens
  misc_feature: GYAE6OF02HUR52.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctcctgaccatctctggctccaggctgaagacgaggctgattattactgcagctcatatacaggcagcagcactcaggttttcgcggtaggaccaagctgaccgtctacggtcagcccaaggctcgcccctggtcc

SEQ ID NO: 151144 - DNA, 501 bp, Homo sapiens
  misc_feature: GYAE6OF02JC3GD.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctggctcaagtctgcgacacggcctccctgaccatctctgggctccagctgaagacgaggctgattattactgcagctcatatacaggcagcagcactctaggtttcggcggaggaccaagctagaccgtcctaggtccacgcccaaggcctcgcccctggtaccc

SEQ ID NO: 151145 - DNA, 511 bp, Homo sapiens
  misc_feature: GYAE6OF02F3WWT.7.5.A05.1.454.CMB.1.raw
tcagcgtgtctctacacgaccggtgctcgatttagatagatagacgagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcacacggcctccctgaccatctctgggctccaggctgaagacgaggctgattattactgcagctcatatacagcagcagcactctaggttttcggcggagggaccaagctcgacccgtcctaggtcacgacccgaaggctccgcccccttcggtaccc

SEQ ID NO: 151146 - DNA, 520 bp, Homo sapiens
  misc_feature: GYAE6OF02IPURM.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggcaaagcccccaaagtcatcatttatgatgtctataatcggccttcgagggtttccaatcgcttctctggctccaagtctggcgacacggcctccctgaccatctcgtggcctccaggctagaagacgaggctgtattattactgcagctcatatacaggcagcagcactcgtacggtttcgggacggacgggaccaagctacgaccgtccgtaggtacacggcccgaaggctccgccccgtcgtcc

SEQ ID NO: 151147 - DNA, 506 bp, Homo sapiens
  misc_feature: GYAE6OF02FRQQR.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccagtctggcacacgcctcctgaccatctctgggctccaggctgagacgaggctgatttattactgcagctcatatacaggcagcagcactcaggtttcgcggaggaccaaggctagaccgtccgtaggtcacgcccgaaggcctcggcccccgtggtacccg

SEQ ID NO: 151148 - DNA, 537 bp, Homo sapiens
  misc_feature: GYAE6OF02JJXLY.7.5.A05.1.454.CMB.1.raw
tcagcgtgtctctacacgaccggtgctcgatttagatagatagacagggggggtcggtcgaggaggcgagcgctctcgggacggtcgtccaccactgcctgggctctgctattcctcaccctcctcactcaggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaacgcccccaaagtcatcatttatgatgtctataatcggccttcgagggtttccaatcgtcttctctggcctccaagtctgggacgacaccggccctccctgacccatctcgtgggcctccgaggctgaagacgaggctgatttattctgcagctcatatacaggcagcagcaactcgtaagggttttcggacgggacgggaaccaaggtctacgaccggtcctaggtcacggcccaaggctccggcccccgtcggtcc

SEQ ID NO: 151149 - DNA, 496 bp, Homo sapiens
  misc_feature: GYAE6OF02IVY0J.7.5.A05.1.454.CMB.1.raw
tcagcgtgtctctacacgaccggtgctcgatttagatagatagacagggggggggtctcaggaggcagtgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcgccttcagggtttcaatcgctctctggctcaagtctggcgacacggcctccctgaccatctctgggctccaggctgaagacgaggctgattattactgcagctcatatacaggcagcagctactctaggtttcgcggaggaccaagctagaccgtctaggtcacgccaaggctcggcccctgtcc

SEQ ID NO: 151150 - DNA, 533 bp, Homo sapiens
  misc_feature: GYAE6OF02GM19E.7.5.A05.1.454.CMB.1.raw
  modified_base (431)..(431): a, c, t, g, unknown or other
  misc_feature (431)..(431): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggacaaacgcccccaaagtcatcatttatgatgtctataatcggccttcgtagggtttccaatcgcttctctgctccaagtctggcgacacggccctccctcgaccactctcgtcgggctccgaggctagaagacgaggctgatttattactgcagctnatatacaggcagcagcactcgtagggtttcggcgggagggaccaaggctacgacccgtcgtacggtcgacgacccgaaggcctccggtcccccgtcggtccc

SEQ ID NO: 151151 - DNA, 530 bp, Homo sapiens
  misc_feature: GYAE6OF02IJPP9.7.5.A05.1.454.CMB.1.raw
  modified_base (299)..(299): a, c, t, g, unknown or other
  misc_feature (299)..(299): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcaggggtttccaatcgcttctctggctccaagtctggcgacacggcctccctgacccatcctctgggcctccgaggctgaagacgagggctggatttattactgcagctcatatacaggcagcagcactcgtaggtttcgggcggacgggtaccaaggctacggacccgttccgtacggtcacgcccgaaggcctcggcccccgtggtcccg

SEQ ID NO: 151152 - DNA, 513 bp, Homo sapiens
  misc_feature: GYAE6OF02GE9Y7.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcgcttcagggtttcaatcgcttctctggctcaagtctggcgacacggcctccctgaccatctctgggctccaggctgaagacgaggctgattattactgcagctcatatacaggcagcagcactcgtaggttttcggcggtaggaccaagctaggacccgtcctaggtccgacgcccgtaaggcctccggcccccgttggtaccc

SEQ ID NO: 151153 - DNA, 521 bp, Homo sapiens
  misc_feature: GYAE6OF02GUD6O.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcgagggtttccaatcgcttctctggctcaagtctggcgacacggcctcctgaccatctctgggctccaggctgaagacgaggctgattattactgcagctcatatacaggcagcagcactcgtaggtttcggacggacgggaccaaggcctaggacccgtcgtacggtcacgcccgaaggccgtacggcccccgtcggtacccg

SEQ ID NO: 151154 - DNA, 510 bp, Homo sapiens
  misc_feature: GYAE6OF02GVHRU.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgacccatctctgggctccaggctgaagacgaggctgattattactgcagctcatatacaggcagcagcactcgaggttttcggcggagggaccaagctcgaccgtcctaggtcacgcccaaggcctcgccccctggtaccc

SEQ ID NO: 151155 - DNA, 512 bp, Homo sapiens
  misc_feature: GYAE6OF02GE2G5.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctgctcaagtctggcgacacggcctccctgaccatctctgggctccaggctgaagacgaggctgattattactgcagctcatatacaggcagcagcactctaggttttcggcggacggaccaagctacgaccgtcctaggtccacgcccaaggcctcggcccccgtcggtaccc

SEQ ID NO: 151156 - DNA, 507 bp, Homo sapiens
  misc_feature: GYAE6OF02FN0XI.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctggctcaggctgaagacgagctgattattactgcagctacatatacaggcagcagcactcgaggttttcggcggagggaccagctcgaccgtccgtaggtcacgccgaaggcctcgtcccccgtggtccc

SEQ ID NO: 151157 - DNA, 538 bp, Homo sapiens
  misc_feature: GYAE6OF02GJ6IT.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctctggtatcaacaataccaggcaaagcccccaaagtcatcatttatgatgtctataatcgcttcagggtttcaatcgcttctctggctccaagtctggcgacacggcctccctgaccatctctggctccagctagagacgaggctgattattactgcagctcatatacaggcagcagcactcgtacgggttttcgggacgggtacgggaccgaacggtccgtacggtacccgttccgtacggtccgaccgacccgaacggccgtccggtacccccgttcggtacccg

SEQ ID NO: 151158 - DNA, 527 bp, Homo sapiens
  misc_feature: GYAE6OF02GL1IH.7.5.A05.1.454.CMB.1.raw
  modified_base (299)..(299): a, c, t, g, unknown or other
  misc_feature (299)..(299): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcagggtttccaatcgcttctctggctccaagtctggcgacacggccctcccgtgacccatcctctcgggctccgaggctgaagacgaggctgattattactgacagctcatatacgagcagcagccactcgtagggtttcggcggaggaccgaagcgtagacccgtacgtacggtccacgcccgaaggcctccgcccccgtcggtaccc

SEQ ID NO: 151159 - DNA, 544 bp, Homo sapiens
  misc_feature: GYAE6OF02HLJ70.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctggctcaagtctggcgacacgcctccctgaccatctctggctccaggctgaacgacgaggctgtattattactgcagctcatataacaggcagacagcactacgtagggttttcggacgggtacgggaaccgaaggtccgtacggaccggtacccgtaggtaccgacggacccgaaacggtccctaccggtcccccgtcggtacccg

SEQ ID NO: 151160 - DNA, 512 bp, Homo sapiens
  misc_feature: GYAE6OF02FTWKI.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcgcttcagggtttccaatcgcttctctggctcaagtctggcgacacggcctccctgaccatctctggctccaggctgaagacgaggctgattattactgcagctcatatacaggcagcagcactcgtaggtttcggcggagggaccaagcgtacgaccgtccgtaggtcgacgacccgaacggcctcggcccccgtggtcccg

SEQ ID NO: 151161 - DNA, 499 bp, Homo sapiens
  misc_feature: GYAE6OF02G7B4K.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaagcccccaaagtcatcatttatgatgtctataatcggcttcagggtttccaatcgcttctctggctccaagtctggcgacacggcctccctgaccatctctgggctccagctgaagacgaggctgattattactgcagctcatatacaggcagcagcactcaggtttcggcggacgggaccaaggctgaccgtctagtgtcacgtccaaggctcgcccctccgg

SEQ ID NO: 151162 - DNA, 517 bp, Homo sapiens
  misc_feature: GYAE6OF02I1HS1.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggtccttcagggtttcaatcgcttctctggctccaagtctgcgacacggcctccctgaccatctcgtggctccgaggctgaagacgaggctgtattattactgcagctcatatacaggcagcagcactcgtaggtttcggcggaggacaaggtctcggaccgtccgtacggtcgacggacccgaaggcctacgtccccgtcggtcc

SEQ ID NO: 151163 - DNA, 513 bp, Homo sapiens
  misc_feature: GYAE6OF02IODCS.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccccaaagtcatcatttatgatgtctataatcggccttcagggtttccaatcgcttctctggctccaagtctggcgacacggcctccctgaccatctctgggctccgagctgaagacgaggctgattattactgcagctcatatacaggcagcagcactcgtaggtttcggcggagggaccaagctagccgtccgtaggtcacgacccgaaggctcgtcccccgtggtcccg

SEQ ID NO: 151164 - DNA, 693 bp, Homo sapiens
  misc_feature: GYAE6OF02JT8VY.7.5.A05.1.454.CMB.1.raw
  modified_base (108)..(108): a, c, t, g, unknown or other
  misc_feature (108)..(108): n is a, c, g, or t
  modified_base (169)..(169): a, c, t, g, unknown or other
  misc_feature (169)..(169): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (623)..(625): a, c, t, g, unknown or other
  misc_feature (623)..(625): n is a, c, g, or t
tcagcgtgtctctacacgaccggtgctcgatttagatagatagacgagggggggtcgtcgaggaggcagcgctctcgggacgtctccaccatggcctgggctctactnttcctcacctcctccactcaggcgacagggtcggtgggtccgacgtctgcctccagtaccngtgcctcgtcgtcctcggtcgtcgtcgtcacgtacgatcacncnccgtacctcgtaccgccacgaccaccgtacgtcgtacgttagtactagttataactactctactacctacgtaactaccaacaactaaccaccgaacctaaacgtacccaactactacttactanactatanagagttcggtaccncttacgtacggttaccgtaccgttaccgttacgttacgaccgtccgtacgtctacggtaccgtaccgtaccgtaccgtaccgtaccgtaccgtaccgtaccgtccgtccgtaccgtaccgtaccgacgttaccgtacggtaccgtaccggttaaccggtaacttaccgtacgtacgctacgttacttacgttacgtacgacgacgtacgtacgtacgtacgtacgtacgtaccggttaccggacgtacgacgtacggtaccggnnncggtacctagggtacccgtacggtacccgtacggtacccgtaccgtacccggtcccgtacggtacccg

SEQ ID NO: 151165 - DNA, 500 bp, Homo sapiens
  misc_feature: GYAE6OF02GP6W5.7.5.A05.1.454.CMB.1.raw
tcagcgtgtctctacacgaccggtgctcgatttagatagatagacaggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggccttcagggtttccaatcgcttctctggctcaagtctggcgacacggcctccctgaccatctctgggctccaggctgaagacgaggctgattattactgcagctcatatacaggcagcagcactctaggtttcgcggagggaccagcgtgaccgtcctaggtcacgcccgaagcctcgccccgtggtccc

SEQ ID NO: 151166 - DNA, 507 bp, Homo sapiens
  misc_feature: GYAE6OF02GLQU8.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacgcctccctgaccatctctgggctccaggctgaagacgaggctgattattactgcagctcatatacaggcagcagcactcgtaggtttcggcggaggaccaggctagaccgtccgtaggtcagcccgaaggctcgcccccgtggtaccc

SEQ ID NO: 151167 - DNA, 536 bp, Homo sapiens
  misc_feature: GYAE6OF02IN2VQ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgctggttataaatatctctcctggtatcaacaatacccaggcaaagcccccaaagtcatcatttatgatgtctaataatcggccttcagggtttccaatcgcttctctggctccaagtctggcgacacggcctccctgaccatctctggcctccgaggctgaagacgaggctagattattactgcagctcatatacaggcagcagcacgtcgtaacgggttttcggacggacgggaccaacggctacggacccgtccgtacggtccacggacccgaaggccctacggcccccgtcggtccc

SEQ ID NO: 151168 - DNA, 593 bp, Homo sapiens
  misc_feature: GYAE6OF02I73LG.7.5.A05.1.454.CMB.1.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctctggtatcaacaataccaggcaaacgacccccaaagtcatcatttangatgtctataatcgccttctagggtttccaatcgcttctctggctccagtctggcgacacgcctcctcgaccactctcgtcgggctccgaggctagaacgacgaggctagattacttactcgcagctacatatacacggacagcacgctaaccgtacgttaacggggttttcgggaccgggtacgggaacccgaacggtccgttaacggaccccggttaccggttaacgggttaccgaaccgggaccccgtaaacggggtcccttaccccggtccccccgttaccgggtacccc

SEQ ID NO: 151169 - DNA, 507 bp, Homo sapiens
  misc_feature: GYAE6OF02GYI7Z.7.5.A05.1.454.CMB.1.raw
  modified_base (362)..(362): a, c, t, g, unknown or other
  misc_feature (362)..(362): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagccccaaagtcatcattatgatgtctataatcgtccttcagggtttcaatcgtcttctctggctcaagtctggcgacacgcctccngaccatctctggctcgaggctgaagacgaggctgattattactgcagctcatatacagcagcagcactcgaggtttcggcggacggaccgaagtctacggaccgtccgtagtccgacgcccgtaaggcctcgcccccgtgtaccc

SEQ ID NO: 151170 - DNA, 545 bp, Homo sapiens
  misc_feature: GYAE6OF02H2AST.7.5.A05.1.454.CMB.1.raw
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaaatatctctcctggtatcaacaatacccagcaaagcccccaaagtcatcatttatgatgtctataatcgcttcagggtttccaatcgcttctctggctcaagtctgcgacacgcctcctgaccatctcgtgggcctccgaggtctagaagacgaggctgtattattacgtgcagctacatataacgaggacagacgaacgactactacgtaacgggtttacgggccggaggggaccaaggcgtacggacccgtcgtaggtccgacgaccccgaaggccctacggcccccgtggtaccc

SEQ ID NO: 151171 - DNA, 517 bp, Homo sapiens
  misc_feature: GYAE6OF02GVQ29.7.5.A05.1.454.CMB.1.raw
  modified_base (366)..(366): a, c, t, g, unknown or other
  misc_feature (366)..(366): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcagtctggcgacacggcctcccngaccatctctgggctccaggctgaagacgaggctgattattactgcagctcatatacaggcagcagcactctagggtttccggcggaggaccaggcgtcgaccgtccgtaggtccacggcccgaacggtcctcgtcccccgtcggtacccg

SEQ ID NO: 151172 - DNA, 507 bp, Homo sapiens
  misc_feature: GYAE6OF02GO53O.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactctaggttttcggcggagggaccaaggctgaccgtccgtaggtcacgcccaaggcctcgcccctcggtcc

SEQ ID NO: 151173 - DNA, 603 bp, Homo sapiens
  misc_feature: GYAE6OF02IB664.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttataaatatctctcctggtatcaacaatacccaggcaaacgcccccaaagtcatcatttatgatgtctataatcggccttgagggtttccaatcgcttctctgctccaagtctggcgacacggcctcctacgaccatcctcgtgggcctccgacggtcaggaagaccgtaggcctagtatttaacgttactgcgtagtctactaattactaacgaggactacgcgacgtctacgttacgtacgggttttccgggacgggtacgggaacccgaaggtccggtaccggtaccccggtccgttaacggtccgaaccggtccccggaaacggtcccgtacccggtacccccgttccggttaccccg

SEQ ID NO: 151174 - DNA, 525 bp, Homo sapiens
  misc_feature: GYAE6OF02GLPTB.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctcgtgggcctccgaggctgaagacgaggctgattattactgcagctcatatacaggcagcagccactcgtaggttttcggcggagggaccaaggcgtacgaccgtccgtacggtcgacgacccgaaggccgtcgtcccccgtcggtaccc

SEQ ID NO: 151175 - DNA, 551 bp, Homo sapiens
  misc_feature: GYAE6OF02HEEZ7.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcgaacaatacccaggcaaagccccccaaagtcatcatttatgatgtctataatcggccttcagggtttccaatcgcttctctggctcaagtctggcgacacggcctccctgaccatctctggctccaggctgaagacgaggctgattattactgcagctcatatacgaggcagcagcactcgtagggttttcgggacgggtacgggaccgaaggccgtacggacccggtccgttacgggttccacggaccccgtaagggcccgttacccggaccccccgttcgggtaccccg

SEQ ID NO: 151176 - DNA, 602 bp, Homo sapiens
  misc_feature: GYAE6OF02FXQIO.7.5.A05.1.454.CMB.1.raw
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
tcagcgtgtctctacacgaccggtgctcgatttagatagatagacagggggggggtcgtcaggaggcagcgctctcgggaccgtctccaccatggccttgggctctgctattcctcaccctcctcactcagggcacagggtcgtgggcccaggtctgccctgacttcagcctgccttccgtgtctgggtctcctggacagtcgatcaccatctcctggcactggaaccacactggacttgctggttataaatntctctctggtatcaactaactaccaggacaaacgcccccaaagtcatcatttangatgtctaagtaagtcgccttcgtaggggtttccaatcgcttctactgctcaagtctggacgacaccggcctccctgacctatccgtcgtcgggtcctcccgacggtctaggaaacggaccggacgggcctaggtaactttacttaacgtgacctagtctactaattaactacgacggcaggacgacgcgaactcgtaagggtttccggacgggaggaacctaggtccgtacggacccgtacggtacggtaccgacgggacccgacggtccgtcccggtacccccgtggtacccg

SEQ ID NO: 151177 - DNA, 519 bp, Homo sapiens
  misc_feature: GYAE6OF02IC7HU.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaaatatctctcctggtatcaacaatacccaggcaaagcccccaaagtcatcattttatgatgtctataatcggcttcagggtttccaatcgcttctctggctccaagtctggcgacacggccctccctcgaccatcctctcgggctccaggctgaagacgaggctgattattactgcagctacatatacaggcagcagcactcgtaggttttcggcggacggaccagcgtagaccgtaccgtagtcacgcccgaaggccgtcgccccgtggtaccc

SEQ ID NO: 151178 - DNA, 512 bp, Homo sapiens
  misc_feature: GYAE6OF02HER3F.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggccttcagggtttccaatcgcttctctggctccaagtctggcgacacggcctccctgacccatctctggctccaggctgaagacgaggctgattattactgcagctcatatacaggcagcagcactcgtaggtttcggcggagggaccaagctcgaccgtccgtaggtcaacgcccgaacggctccgcccccgtggtccc

SEQ ID NO: 151179 - DNA, 542 bp, Homo sapiens
  misc_feature: GYAE6OF02H9KLO.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttactgatgtctataatcggccttcagggtttccaatcgcttctctggctcaagtctggcgacacggccctccctcgaccatcctctgggctccaggctagaagacgacggctgattattactgcagctcatatacaggcagcagcactcgtacggttttcgggacggacgggaaccgaggcgtacgaccgtcccgttacggtaccgacgacccgaacggccgtccggaccccccgtcggtaccccg

SEQ ID NO: 151180 - DNA, 519 bp, Homo sapiens
  misc_feature: GYAE6OF02F4SRB.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccagctgaagacgaggctgattattactgcagctcatatacaggcagcagcactcgtaggttttccggcggacggaccgaagctaggtacccgtccgtaggtacacgaccgaaggcctcgcccccgtggtacccg

SEQ ID NO: 151181 - DNA, 845 bp, Homo sapiens
  misc_feature: GYAE6OF02I48ED.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcatcggaaccaccgactcgtacgttgacgttggttaaataaagttactacttacctccgtaggttactacgaaactaactaaccaagggaccaaaacggacccccccaaaaaggttccaaacgttaccaatttttaactaggtaatttaggttaccttaaattaaacgttaccgggtacccttttacgtaacggggggtttttacccaaaacgtttaccggtaccttttaccgttaccgttcggggtacctttacccgtaaacggtttccgtttacggggaccggtaaaccgtaacccggggtaccccttacccccgttacgggtaaacccctaacgtttacccgttaccgttaccggggtacccgttacccggtaacgggtaccgttacgggaaacggtaaaccgggtaaacgggtaccgttacggtaacgtttaacgtttaaaccgttacgtaccgtaacgtaccgtacgtaacgttaacgttaaccgtaacggtaccgtaacggaaccgtaacggtaccgtaaccgttaaccggttaaccgggtttaccgggtaccggggtacgggtaaccggtaacgacgtacgtaccgtaccgtacggtacgaccgaccgacggtaccgtaccgtcccg

SEQ ID NO: 151182 - DNA, 515 bp, Homo sapiens
  misc_feature: GYAE6OF02IXXN7.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccgagctgaagacgaggctgattattactgcagctcatatacaggcagcagcactctaggtttcggcggacgggaccaaggctacggaccgtccgtaggtcacgccgaacggctcgtcccccgtgtaccc

SEQ ID NO: 151183 - DNA, 503 bp, Homo sapiens
  misc_feature: GYAE6OF02GSE3O.7.5.A05.1.454.CMB.1.raw
  modified_base (421)..(421): a, c, t, g, unknown or other
  misc_feature (421)..(421): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctnatatacaggcagcagcactcgtaggtttcggcggaggaccagctgaccgtctaggtcacgcccgaaggcctcgcccctgtcc

SEQ ID NO: 151184 - DNA, 496 bp, Homo sapiens
  misc_feature: GYAE6OF02I3FPC.7.5.A05.1.454.CMB.1.raw
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggcttcagggtttcaatcgcttctctgctcaagtctggcacacggcctccctgaccactctntcggctccaggctgaagacgaggctgattattactgcagctnatatacagcagcagcacncgtagtttcggaggaggaccaggctcgaccgtctagcacgccgaaggctacgccccgtgtacc

SEQ ID NO: 151185 - DNA, 523 bp, Homo sapiens
  misc_feature: GYAE6OF02IKQ0X.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggccttcagggtttccaatcgtcttctctggctccaagtctggcgacacggcctccctgaccatctctgggcctccaggctgaagacgaggctgattattactgcagctcatatacaggcagcagcactcgtaggttttcggacgggaggaccgaagcgtacgaccgttccgtaggtcgacgacccgaaggccgtcgcccccgtcggtcccg

SEQ ID NO: 151186 - DNA, 526 bp, Homo sapiens
  misc_feature: GYAE6OF02H4WPV.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgctggttataaatatctctcctggtatcaacaatacccaggcaaaagcccccaaagtcatcatttatgatgtctataatcgccttcagggtttccaatcgcttctctggctcaagtctggcgacacggcctcctcgaccatctctggctccaggctgaagacgaggctgtattattactgcagctcatatacagcagcagcactcacggttttcggcggacgggaccaaggctacggacccgtccgttacggtccgtacgaccccgaacggcctcgtccccccgtcggtaccccg

SEQ ID NO: 151187 - DNA, 551 bp, Homo sapiens
  misc_feature: GYAE6OF02JE3HI.7.5.A05.1.454.CMB.1.raw
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggacaaacgcccccaaagtcatcatttatgatgtctataatcggccttcagggtttcatcgcttctctgctcagtctgcgacncgcctccncgacctatctcgtcggtcctccgacggctagaaggacggagcgtagtattacttacgtgcgacgtctacatatacgagacagacacgctactcgtagggtttacgggacggtacggaacgacgtcgtaccggtaccgtaccgttacggtaccgaccgaccgtacggccgtcccggccccgtccggtcc

SEQ ID NO: 151188 - DNA, 511 bp, Homo sapiens
  misc_feature: GYAE6OF02I44P6.7.5.A05.1.454.CMB.1.raw
  modified_base (423)..(423): a, c, t, g, unknown or other
  misc_feature (423)..(423): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggccttcagggtttcaatcgcttctctggctccaagtctggcgacacggcctccctgaccatctctcggctccaggcctgaagacgaggctgattattactgcagctcattanacaggcagcagcactcgtaggtttcgggacggacgggaccaaggctagaccgtcctaggtcacgccctaaggctacgccccgtcgtcc

SEQ ID NO: 151189 - DNA, 550 bp, Homo sapiens
  misc_feature: GYAE6OF02I75MO.7.5.A05.1.454.CMB.1.raw
  modified_base (247)..(247): a, c, t, g, unknown or other
  misc_feature (247)..(247): n is a, c, g, or t
  modified_base (421)..(421): a, c, t, g, unknown or other
  misc_feature (421)..(421): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaataccaggcaaacgcccccaaagtcatcatttatgatgtctataatcggccttcagggtttccaatcgtcttctctggctccaagtctggcgacacgcctccctgaccatctctgggctccaggctgaagacgaggctgtattattactgcagctnatatacagcagcacgctactcgtagggttttcgggacgggacgggaccgaaggtccgtcggaaccggtcccgttagggtaccgacggtccccgaacggtccgtacccggtacccccgtcggttaccccg

SEQ ID NO: 151190 - DNA, 523 bp, Homo sapiens
  misc_feature: GYAE6OF02HQFGX.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcgagggtttccaatcgcttctctggctcaagtctggcgacacggcctccctgaccatctctcggctccgaggctagaagacgaggctagattattactgcagctcatactacgagcagcagcactctaggtttcggcgggaggaccgaagtcgtacggacccgtccgtacggtcacgcccgaaggcctccgtccccgtcggtaccc

SEQ ID NO: 151191 - DNA, 515 bp, Homo sapiens
  misc_feature: GYAE6OF02G70DE.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcgagggtttccaatcgcttctctggctccaagtctggcgacacggcctccctgaccatctctgggcctccgagctgaagacgaggctgattattactgcagctcatatacaggcagcagcactctaggtttcggcggaggaccaagcgtacgaccgtccgtacggtcacgcccgaaggcctcggccccctcggtccc

SEQ ID NO: 151192 - DNA, 523 bp, Homo sapiens
  misc_feature: GYAE6OF02H0897.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggcttcgagggtttccaatcgcttctctggctcaagtctggcgacacggcctccctgaccatctctcgggctccgaggctgaagacgaggctgattattacgtgcagctcattatacgaggcagcagcactcgtaggtttcggcgggacgggaccgaagctcggacccgttcgtaggtccacggcccgaggcctccggcccccgtcggtccc

SEQ ID NO: 151193 - DNA, 538 bp, Homo sapiens
  misc_feature: GYAE6OF02HREQ4.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacggcctccctgaccatctctgggctccgaggctgaagacgaggctgattattactgcagctcatatacaggcagcagcactcgtaggttttcggcggtacgggaccgtaaacggccgtcgaccgtcccgttaacggtcgacggaccccaaaggtccgtacggtccccccgtcggtacccg

SEQ ID NO: 151194 - DNA, 552 bp, Homo sapiens
  misc_feature: GYAE6OF02IQQ36.7.5.A05.1.454.CMB.1.raw
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccttgacagtcgatcaccactctcctgcactcggaaccaccactgacgttgctggttataaatatctctcctggtatcaacaactaccagacaaacgccccaaacgtacatcatttatgatgtctataatcgcttcagggttcaatcgctntctgctcaagtctgcgtacacgcctccncgacatctcgtggctccgaggctagaagcgaaggctgtattattacgtgcacgctacgtataactacgacggacaacgcgaacgctaaacctcgtaacggggttttcggacgggtacgggaaccaacggtctcggaccgtaccgtaggtacgaccgaccaaggccgtccgtccccggtcggttacccg

SEQ ID NO: 151195 - DNA, 529 bp, Homo sapiens
  misc_feature: GYAE6OF02IM01G.7.5.A05.1.454.CMB.1.raw
  modified_base (385)..(385): a, c, t, g, unknown or other
  misc_feature (385)..(385): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctgctcagtctggcgacacgcctcctcgaccatctctgggcctccnggctggaagacgaggctgtattattactgcagtctcatatacgaggcagcagcactcgtacggtttcggcgggtacggaccaaggctacggacccgttaccgtaggtccacggcccgaaggcccgtccgcccccgtcggtcccg

SEQ ID NO: 151196 - DNA, 550 bp, Homo sapiens
  misc_feature: GYAE6OF02F4VDF.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgcccccaaagtcatcatttatgatgtctataatcggtccttcagggtttccaatcgcttctctggctcagtctggcgacacggccctccctcgaccatctctgggtctccgaggctgaagacggaggctagtattattacgtgcagctctatacttacgaggcagcagctactcgtaggttttcgggacggtacgggaccgaacggtcgtcggtaccggtaccgtacggtacgacgacccgaacggccgtccggtccccgtcggttacccg

SEQ ID NO: 151197 - DNA, 493 bp, Homo sapiens
  misc_feature: GYAE6OF02HQ8A8.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccagcaaagcccccaaagtcatcatttatgatgtctataatcggccttcagggtttccaatcgcttctctggctcaagtctgcgacacggcctccctgaccatctctgggctcaggctgaagacgaggctgattattactgcagctcatatacaggcagcagcactcaggtttcgcggaggacaagctgaccgtctaggtcagcccaaggctacgccccgtgtcc

SEQ ID NO: 151198 - DNA, 535 bp, Homo sapiens
  misc_feature: GYAE6OF02HN2MX.7.5.A05.1.454.CMB.1.raw
  modified_base (455)..(455): a, c, t, g, unknown or other
  misc_feature (455)..(455): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggcctcaggctgaagacgaggctgattattactgcagctcatatacagcagcagcacgtctagggttttccgggnggtacgggaccgtaaggcgtcggaccgttcccgtaggttccacggaccccgaaaggccgtccgtccccccgtcggtaccc

SEQ ID NO: 151199 - DNA, 524 bp, Homo sapiens
  misc_feature: GYAE6OF02G430G.7.5.A05.1.454.CMB.1.raw
  modified_base (424)..(424): a, c, t, g, unknown or other
  misc_feature (424)..(424): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggcctccgagctgaagacgaggctgattattactgcagctcatanacaggcagcagcactcgtagggttttcggcggtacgggaccaaggcctacggacccgtcgtacggtcgacgcccgaaggcctcggcccccgtcggtaccc

SEQ ID NO: 151200 - DNA, 520 bp, Homo sapiens
  misc_feature: GYAE6OF02HXCYB.7.5.A05.1.454.CMB.1.raw
  modified_base (222)..(222): a, c, t, g, unknown or other
  misc_feature (222)..(222): n is a, c, g, or t
  modified_base (384)..(384): a, c, t, g, unknown or other
  misc_feature (384)..(384): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccncactgacttgctggttataaatatctctcctggtatcaacaatacccaggcaaagcccccaaagtcatcatttatgatgtctataatcggcctttcagggtttccaatcgcttctctggctccaagtctggcacacggcctccctgaccatctctggctccnggctgaagacgaggctgattattactgcagctcatatacaggcagacagcactcgtaggttttcggacggacgggaccaacggctacgaccgtcctacggtccgacgcccaaggcctacggcccccttcggtaccc

SEQ ID NO: 151201 - DNA, 513 bp, Homo sapiens
  misc_feature: GYAE6OF02IOYDA.7.5.A05.1.454.CMB.1.raw
  modified_base (420)..(420): a, c, t, g, unknown or other
  misc_feature (420)..(420): n is a, c, g, or t
tcagcgtgtctctacacgaccggtgctcgatttagatagatagacagggggggggtctcaggaggcagcgctctcgggacgtctccaccatggcctgggctctgctattcctcacccctcctcactcagggcacagggtcgtgggcccagtctgccctgactcagcctgcctccgtgtctgggtctcctggacagtcgatcaccatctctgcactggaaccaccactgacgttgctggttataaatatctctcctggtatcaacaatacccaggcaaagcccccaaagtcatcatttatgatgtctataatcggcttcgagggtttccaatcgcttctctggctcagtctggcacacggccctcctgaccatctctggcctccaggctgaagcgaggctgatttattactagcctagctnatatacgagcagcagcacgtcgtagggtttcgcggtacgggacaagctcgaccggtctaggacacgacccgaggtcctacgccccctggtccc

SEQ ID NO: 151202 - DNA, 534 bp, Homo sapiens
  misc_feature: GYAE6OF02JYQME.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggacaaagcccccaaagtcatcattatgatgtctataatcggtccttcgagggtttccaatcgcttctctgctcagtctggcgacatcggccttccctgacctatctcgtgggcctccgaggtctagaacgacggagcctagtattattactgctagctacatactacgaggacagcacgcactcgtacggtttcgacggtaggacgacgtcgtacgtaccgtccgtaggtcgacggcccgaacggtccgtccgccccgttccgg

SEQ ID NO: 151203 - DNA, 516 bp, Homo sapiens
  misc_feature: GYAE6OF02G62AE.7.5.A05.1.454.CMB.1.raw
  modified_base (247)..(247): a, c, t, g, unknown or other
  misc_feature (247)..(247): n is a, c, g, or t
  modified_base (368)..(368): a, c, t, g, unknown or other
  misc_feature (368)..(368): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggcaaagcccccaaagtcatcatttatgatgtctataatcggcttcagggtttccaatcgcttctctggctccaagtctggcgacacggcctcccngaccatctctgggctccgaggctgaagacgaggctgattattactgcagctcatatacgaggcagcagcactcgtaggtttcggcggagggaccaagctcgaccgtccgtaggtccgacgcccgaaggcctccggtccccgtggtccc

SEQ ID NO: 151204 - DNA, 599 bp, Homo sapiens
  misc_feature: GYAE6OF02F6K1A.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggacaaacgacccccaaagtcatcatttatgatgtctataatcggccttcgagggtttccaatcgcttctctgctcaagtctgcgacacgcctcctacgacctatctcgtcgggtactcgaggtctagaacggacgaggctagatttacgttacgtgtacacgtctactattaactacgaggtcaagtcacgctacgttcgttaacgggtttccgggacggtacgggaacctaacggtcccgtacggttaaccccggttaccgttaacggttacccgaccggtaccccgaacgggtcccgtcccggtacccccgtcggttaccccg

SEQ ID NO: 151205 - DNA, 510 bp, Homo sapiens
  misc_feature: GYAE6OF02FM7MP.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcagtctggcgacacggcctccctgaccatctcgtggctccgagctgaagacgaggctgattattactgcagctcatatacagcagcagcactctagggtttcgcggtaggaccaagtcgtgacccgtccgtaggtacacgcccgaaggcctcggccccgtgtcccg

SEQ ID NO: 151206 - DNA, 521 bp, Homo sapiens
  misc_feature: GYAE6OF02G8Y9E.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggcaaagcccccaaagtcatcatttatgatgtctataatcgccttcagggtttccaatcgtcttctctggctcaagtctggcgacacggcctccctgaccatctcgtgggctccgaggctgaagacgaggctgattattactgcagctacatatacaggcagcagcaactcgtaggtttcggcggagggaccaaggtctacggacccgtcgtacggtcacgcccgaaggcctcgtccccgtcgtacccg

SEQ ID NO: 151207 - DNA, 538 bp, Homo sapiens
  misc_feature: GYAE6OF02IXZCL.7.5.A05.1.454.CMB.1.raw
  modified_base (366)..(366): a, c, t, g, unknown or other
  misc_feature (366)..(366): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttataaatatctctcctggtatcaaacaatacccaggcaaagccccccaaaagtcatcatttatgatgtctataatcggcctttcgagggtttccaatcgtcttctctggctccaagtctggcgacncggcctccctgacccatcctcgtcgggctccgaggctaggaagacgagggctagatttattactgcagctcaatataacaggtcacgcagactactcgtagggttttccggcgggaggaccaggctcgaccgtcgtacggcacggaccaggtcctccgtccccgtcggtacc

SEQ ID NO: 151208 - DNA, 706 bp, Homo sapiens
  misc_feature: GYAE6OF02HY0AA.7.5.A05.1.454.CMB.1.raw
  modified_base (154)..(154): a, c, t, g, unknown or other
  misc_feature (154)..(154): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
tcagcgtgtctctacacgaccggtgctcgatttagatagatagacaggggggtcgtcgaggaggcgagcgctctcgggacgtctccacatggcctgggctctcgctattcctcaccctcctcactcacggcactagggtcgtcgggcccagtcncgccctgactcacgcctgcctccgtgtctcgggtctcctggacagtccgatcacatctcctgacatcggaaccacctatgacgttncttggtanaaatatctctcctggtatcaanaagtacccagcaaagccccaaagtcaatccaatttagtcgatcgtctataactcggtcttacgagggtttccaatcggctttcaacgtcggctacctaagcgttacggcgaacggtaccgacccttcccttggaaacccctatttcctacgttcggggccttccgaaacggtcttacggaaacgtacgtaaacggggcttggaattttaaacggtttaaaccttgtaccgtaacggcccgtttaactaaacgtttaaccgtaaacggacggtaccgaacgccgtaacgtacctaaccggttacggttaacgggttttaccgggacgggtaacccgggtaaccgttaacggtaccggtaccggttacccggtaacccgttaccgtcggtaccgaacccggtacggtacccgttccccgtaccccggtacgttacccg

SEQ ID NO: 151209 - DNA, 543 bp, Homo sapiens
  misc_feature: GYAE6OF02IIBI1.7.5.A05.1.454.CMB.1.raw
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (501)..(501): a, c, t, g, unknown or other
  misc_feature (501)..(501): n is a, c, g, or t
tcagcgtgtctctacacgaccggtgctcgatttagatagatagacagggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgccccaaaagtcaatcattatgatgtctataatcggccttnagggtttccaatcgcttcnctaggctccaagtctggcacacggccttccngaccatctcnggctcagctgaagcgaggctgtattaacgttacagcagtctcaattanaacgagaccagctaacgcacttcaagggttttcgggcggagggaaccaaggcgtggtaacccgtctaacgggtnaacggcccgaaacggccgtttaccgccccccgtggtaacccc

SEQ ID NO: 151210 - DNA, 554 bp, Homo sapiens
  misc_feature: GYAE6OF02HCMUX.7.5.A05.1.454.CMB.1.raw
  modified_base (431)..(431): a, c, t, g, unknown or other
  misc_feature (431)..(431): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgctggttataaatatctctcctgtatcaacaataccaggcaaacgcccccaaagtcatcattatgatgtctataatcggtccttcgagggttccaatcgtcttctctgctcaagtctggcgacacggcctcctcgaccatctcgtcgggctccgaggtctagaacgtacgaggctgtattattactgcagtctacatanacgagcagcagactacgtacgtacgggtttcggacgggacgggaccgaaggccgtacggtacccggtaccgtaacggtccgaacggacccgtaacggccgtccggtccccccgttcgtacccg

SEQ ID NO: 151211 - DNA, 494 bp, Homo sapiens
  misc_feature: GYAE6OF02JEWGH.7.5.A05.1.454.CMB.1.raw
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataaatntctntcctgtatcaacaatacccaggcaaagccccaaagtcatcatttangatgtactataatcggccttnagggtttccaatcgcttctctggctcaagtctggcacacgcctccctgaccatctctggctcgagctagaagcgaggctgattatactgcagctcatatacagcagcagcactnaggtttcgcggtaggaccaagctgaccgtcgtacggtcacggccaacgcgtacgcccctaggtcc

SEQ ID NO: 151212 - DNA, 601 bp, Homo sapiens
  misc_feature: GYAE6OF02F8S65.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagacccccaaagtcatcatttatgatgtctataatcggtccttcgtagggtttccaatcgcttctctggctcagtctgcgacacgcctccctgaccatctcgtcggtctccgagctagaagacgaggctagtattattactgcagctactatactacgaggacacgcacgactaccgttacgtacgggttttacgggaccgggtacggggaacccgtaacggtaccgttacgggtaaccccggttacccgttaacgggttacccgaaccggtaccccgtaaaccgggtcccgtacccggtacccccccggtacccggttaccccg

SEQ ID NO: 151213 - DNA, 532 bp, Homo sapiens
  misc_feature: GYAE6OF02HOL6H.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccaggcaaacgcccccaaagtcatcatttatgatgtctataatcggccttcgagggtttccaatcgcttctctgctcaagtctggcacacggcctccctgaccatctctggctccgagcgtgaagacgaggtctagtattattactgcagctcatatacagcagcagcactcgaggttttcggacggtacgggacgaacggtcgtcgtacccgtccgtaaggttccacggaccccgaaggccgtccggcccccgtcgtacccg

SEQ ID NO: 151214 - DNA, 637 bp, Homo sapiens
  misc_feature: GYAE6OF02JNUPS.7.5.A05.1.454.CMB.1.raw
  modified_base (297)..(297): a, c, t, g, unknown or other
  misc_feature (297)..(297): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (448)..(448): a, c, t, g, unknown or other
  misc_feature (448)..(448): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgccccaaagtcatcatttancgtatgtctataactcgccttcagggttcaatcgcttctctgctcaagtctgcgacacgctcccngaacctntctcgtcgggtcctccgaggctacggaacgacggtaggtcgtaggtaactttacgttacgtacgacgtaacgtccttanaacttaagtaacctacgggtcaacggtccaaggacctacgttaccggtaagggtttttaccgggaccgggtaacgggtaacccgaacggttcccgtaaccggtaacccggttacccgtaacgggttacccgaaccgggtaccccgtaaacgggtcccgttaacccggtcccccgttccggtaaccccgg

SEQ ID NO: 151215 - DNA, 744 bp, Homo sapiens
  misc_feature: GYAE6OF02J2D58.7.5.A05.1.454.CMB.1.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagcgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaanaaatntctctcctgtatcaacaatacccaggacaaacgcccccaaagtcatcatttatgtatcgttctaattaacgtccggtacctttacggtaacggggttttaccctaaacgttccggtacctttccttccgtcgggtcccttaccgtaaacgttcgttacgggaccgaaccgtaaccccggtcccttaccccgtacgtaccctacgttcccttccggtcggggtaccctaccggtacggtcgtaacggtaacggaaccggtacggtccgttaggtaactttacgttaaccgtcgacgtacgtcttactaacttaacgttaccgaacgggtacacgtaccgacgtaccctaccgttacggttacgggttttaccgggacgggtaaccgggtaacccgtaacggtccggttaccggaccgttccggttaacggttaccgaccggtaccccggtaacgggtaccccgtacccggtaccccccggttccggttaaccccg

SEQ ID NO: 151216 - DNA, 624 bp, Homo sapiens
  misc_feature: GYAE6OF02HKRPS.7.5.A05.1.454.CMB.1.raw
  modified_base (317)..(317): a, c, t, g, unknown or other
  misc_feature (317)..(317): n is a, c, g, or t
tcagcgtgtctctacacgaccggtgctcgatttagatagatagacagggggggggtctcgaggaggcagcgctctcgggacgtctccaccatggcctgggctctgctattcctcaccctcctcactcagggcacagggtcgtgggcccagtctgccctgactcagccctgcctccgtgtctgggtctcctggacagtcgatcaccatctcctgcactcggaacccaccactgtacgttgtcttagttaataatactctctcctggtactacaacaactaccgaggacaacgaccccaaagtcatcatttatgatgtntaataactcggtccttagtacgggttacaactcgtcttctctggctcaacgtctcggacgacgtaccggcccttcccgtcgaccctattcctcggtcggtcctccgagtctaggaacgacggacggctagtaattacttacgtcgctacgtctacgaattaagtacgacggacacgtacacgactacgtacggttacgggttttcgggacgggtacgggaaccgaaggtccgtaccggtaccggttaccggttacggacgtaccggtaacccgaacggtccggtacccgtccccggtaccgtacccg

SEQ ID NO: 151217 - DNA, 517 bp, Homo sapiens
  misc_feature: GYAE6OF02IZRM6.7.5.A05.1.454.CMB.1.raw
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagcgtgtctctacacgaccggtgctcgatttagatagatagacagggggggggtctcaggaggcagcgctctcgggacgtctccaccatggcctgggctctgctattcctcacccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaagcccccaaagtcatcatttatgatgtctataatcggccttcagggtttccaatcgcttctctggctccaagtctggcgacacggcctccctgaccattcctcgtcggcctccgagctaggaagacgaggctgattattactgcagctcatatacaggnagcagcactcgtaaggtttcggngaggacagctggaccgtcgtacggtacgacgccgaacgctccgtccccgtcgtaccc

SEQ ID NO: 151218 - DNA, 529 bp, Homo sapiens
  misc_feature: GYAE6OF02H2014.7.5.A05.1.454.CMB.1.raw
  modified_base (361)..(361): a, c, t, g, unknown or other
  misc_feature (361)..(361): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatatctctcctggtatcaacaataccaggcaaagcccccaaagtcatcatttatgatgtactataatcggtccttcgagggtttccaatcgtcttctctggctcaagtctggcgacncggcctcctcgaccatcctctgggctccgaggctagaagacgaggctgtattattactgcagtctacatatacaggcagcacncactcgtagggtttccggnggacggacgaacgcgtacgaccgtcgtacggtcacggtaccgacggtcctccgccccgtcgtaccc

SEQ ID NO: 151219 - DNA, 510 bp, Homo sapiens
  misc_feature: GYAE6OF02G0NZN.7.5.A05.1.454.CMB.1.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaacgcccccaaagtcatcatttatgatgtctataatcggccttcgagggtttccaatcgcttctctggctcaagtctggcgacacgcctccctgaccactctctgggctccgaggctgaagacgaggctgattattacngcagctnatatacgagcagcagctactcgtaggtttcgcggaggaccaggctgaccgtcgtacgtacgacgcccgaagcctcgccccctcggtacc

SEQ ID NO: 151220 - DNA, 530 bp, Homo sapiens
  misc_feature: GYAE6OF02HAIWQ.7.5.A05.1.454.CMB.1.raw
  modified_base (378)..(378): a, c, t, g, unknown or other
  misc_feature (378)..(378): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaacaataccaggacaaacgaccccccaaagtcatcatttatgatgtctaataatcggtccttcgtagggtttaccaatcgtcttctctgctcaatctggcacgaccgcctcccngaccatctcgtggcctcgaggctagaacgacgaggctagtattattactgacagctcaatatacgagcagcagcactagtcgggtttcggacgggacggaccagtcgtacgaccgtctacggtcacgcccgagtccgcctcccgtcggtacc

SEQ ID NO: 151221 - DNA, 566 bp, Homo sapiens
  misc_feature: GYAE6OF02IOVXA.7.5.A05.1.454.CMB.1.raw
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagacaaagcccccaaagtcatcatttatgatgtctataatcggtccttcgagggtttaccatcgcttctctgctccaagtctgcgacacggcctcctcgaccatctcgtcgggctccgaggcgtagaaacgacggaggctagaatttacttacgtgacacgctcaatatacaggcagcagacctactccgttagggtttccgggacgggtagggacctaacggcgtacggacccgttaccggtacggtaccacggaccccgtaagggccctacccggtcccccgtccggtaccc

SEQ ID NO: 151222 - DNA, 520 bp, Homo sapiens
  misc_feature: GYAE6OF02HDY4S.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagcccccaaagtcatcatttatgatgtctataatcggccttcagggtttccaatcgcttctctggctccaagtctggcgacacggcctccctgaccatctctggctccagctgaagacgagctgattattactgcagctcatatacaggcagcagcactctagggttttcggcggtagggaccgaagcgtcgaccgtaccgtacggtcacgcccgaaaggccgtaccgcccccgtcggtacc

SEQ ID NO: 151223 - DNA, 535 bp, Homo sapiens
  misc_feature: GYAE6OF02HHYEZ.7.5.A05.1.454.CMB.1.raw
  modified_base (344)..(344): a, c, t, g, unknown or other
  misc_feature (344)..(344): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaactaccagcaaagcccccaaagtcatcattatgatgtctataatcgcttcagggttccaatcgcttctctggctcagtcnggcgacacggcctccctgacctatcgtctgggcctccgaggctagaacgacgaggctgtattacttactgacagctacagtatacgagtcacgcagctacgtcgtaggtttcgggacggacgggtaccaaggctacggacccgtccgtacggccacggcccgaaaggtccctaccggccccgtcggtaccg

SEQ ID NO: 151224 - DNA, 531 bp, Homo sapiens
  misc_feature: GYAE6OF02GO0KB.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagcccccaaagtcatcatttatgatgtctataatcggccttcgagggtttccaatcgtcttctctgctcaagtcgtggcgacacggccctccctcgaccactctcgtcgggcctccgagctgaagacgaggctagatttattacgtgacagctactatactacgaggcagcagcactcgtacggtttcggcggaggaccagcgtacgaccgtcgtacggtcacgacccgaaggcctccggtccccgtcggtaccc

SEQ ID NO: 151225 - DNA, 530 bp, Homo sapiens
  misc_feature: GYAE6OF02HI930.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccagcaaacgcccccaaagcatcatttatgatgtctatatcgccttcgagggtttccatcgcttctctgctcaagtctggcgacacggcctccctgaccatcctctcgggcctccgacggctagaaggacgaggtctagtattattacgtgcagtctcattatacgaggcagccagctactcgtagggtttcggcggacgggaccaacggcgtacgtaccgtccgtacggtcgacgccgacggcctccgccccgtcggtcc

SEQ ID NO: 151226 - DNA, 575 bp, Homo sapiens
  misc_feature: GYAE6OF02JZMIF.7.5.A05.1.454.CMB.1.raw
  modified_base (246)..(246): a, c, t, g, unknown or other
  misc_feature (246)..(246): n is a, c, g, or t
  modified_base (331)..(331): a, c, t, g, unknown or other
  misc_feature (331)..(331): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttggtaataatntctctcctggtatcaacaatacccgaggacaaacgccccaaagtcatcattatgatgtctataatcgcttcagggtttccaatcncttctcgtgctcaagtctggcgacacggcctcctacgacctactctcgtcggcctccgaggcgtagaacggacgtaggcttagtaacttagttacctagacgtacgtctacgaattagtaccgtagaccacgtactacgcctaagtacggttaacggtttacggcgggacggacctaggtccgtacgaccgttacgtacggtacaccgtacccgaaggtcctcccggaccccgttggtaccccg

SEQ ID NO: 151227 - DNA, 557 bp, Homo sapiens
  misc_feature: GYAE6OF02H6UMJ.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctggtatcaacaactaccaggacaaacgacccccaaagtcatctaatttatgatgtactaataatcggtccttcgacgggtttccaatcgtcttctctgctacaagtctggcgacaccggcctcctcgaccatctcgtcggtctccgaggctaggaagacgacggctagtattaattactgcagctacaatatacgaggcagcagcactcgtacggtttcggacgggtacggaccaggcgtacgtaccgtccgttacggtacgacgaccgaacggtccgtccgtcccccgtcggtacccg

SEQ ID NO: 151228 - DNA, 515 bp, Homo sapiens
  misc_feature: GYAE6OF02HPU24.7.5.A05.1.454.CMB.1.raw
  modified_base (368)..(368): a, c, t, g, unknown or other
  misc_feature (368)..(368): n is a, c, g, or t
  modified_base (409)..(409): a, c, t, g, unknown or other
  misc_feature (409)..(409): n is a, c, g, or t
  modified_base (411)..(412): a, c, t, g, unknown or other
  misc_feature (411)..(412): n is a, c, g, or t
  modified_base (419)..(419): a, c, t, g, unknown or other
  misc_feature (419)..(419): n is a, c, g, or t
  modified_base (498)..(498): a, c, t, g, unknown or other
  misc_feature (498)..(498): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggccttcgagggtttccaatcgcttctctggctccaagtctggcgacacgcctccctnacccatctctggctccagctgagacgagctgattattactncnnctcatanacagcagcagccactcgtacggtttcggacggagggacctaaggctcggaccgtccgtacgtcacgacccgaaggtccnccgcccctcggtacccg

SEQ ID NO: 151229 - DNA, 508 bp, Homo sapiens
  misc_feature: GYAE6OF02GPOGJ.7.5.A05.1.454.CMB.1.raw
  modified_base (429)..(429): a, c, t, g, unknown or other
  misc_feature (429)..(429): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttcaatcgcttctctgctcaagtctggcgacacgcctccctgaccatctctggctccgagctgaagacgaggctgattattactgcagctacatatacaggcagcngacactctaggtttcggcggagggaccaggtctacgccgtaccgtaggtcacgcccgaggcctcgccccgtcggtaccg

SEQ ID NO: 151230 - DNA, 508 bp, Homo sapiens
  misc_feature: GYAE6OF02HNEA2.7.5.A05.1.454.CMB.1.raw
tcagcgtgtctctacacgaccggtgctcgatttagatagatagacagggggggggtctcaggaggcagtgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccaggcaaagcccccaaagtcatcatttatgatgtctataatcggccttcgagggttttcaatcgcttctctgctcaagtctggcgacacgcctccctgaccatctctggctccagctgaagacgaggctgattattactgcagctcatactacgagcagcagcactcgtaggtttcggcggtacggaccagtctcgaccgtcgtacgtcacgccgaacggcctcgcccctcggtacc

SEQ ID NO: 151231 - DNA, 599 bp, Homo sapiens
  misc_feature: GYAE6OF02I7TCE.7.5.A05.1.454.CMB.1.raw
  modified_base (247)..(247): a, c, t, g, unknown or other
  misc_feature (247)..(247): n is a, c, g, or t
  modified_base (372)..(372): a, c, t, g, unknown or other
  misc_feature (372)..(372): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggcaaagcccccaaagtcatcatttatgatgtctataatcggccttcgagggttccaatcgcttctctgctcagtctggcacacggcctccctcgacctntctcgtcggctccgaggctaggaacgacgacggtctagtatttattactgacagtctactagtactacgagtcaagtcgacgacctacgtacgttacgggttttaccgggacggggtaacgggaaccgtaacggtccgtaccggtaacccggttacccgttaacggtaccgtaaccggtaccccgtaaacgggtcccgtacccggtccccccgtaccggttaccccg

SEQ ID NO: 151232 - DNA, 513 bp, Homo sapiens
  misc_feature: GYAE6OF02G89J7.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaatacccaggcaaagcccccaaagtcatcattatgatgtctataatcggccttcagggtttccaatcgcttctctggctcagtctgcgacacgcctcctgaccatctctggctccgagctgaagacgaggctgattattactgcagctcatatacagcagcagccatcgtaggttttcggcggacggaccgaagcgtacgtaccgtccgtagtcgacgaccgaggtcctccggtccccgtacggtacccg

SEQ ID NO: 151233 - DNA, 516 bp, Homo sapiens
  misc_feature: GYAE6OF02GJKPL.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaaacaataccaggcaaagcccccaaagtcatcatttatgatgtctataatcggccttcagggtttcaatcgcttctctgctcaagtctggcgacactgcctccctgaccatctctggctccaggctagaagacgaggctgtattattactgcagctacatataacagacagacagccactcgtaggtttcggacggacgggaccgaaggctacggaccgtccgtaggtcacgacccgaaggcctccgcccctcgg

SEQ ID NO: 151234 - DNA, 554 bp, Homo sapiens
  misc_feature: GYAE6OF02FKKOW.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctcaagtctggcgacacggcctccctgaccatctctgggctccaggctgaagacgaggctgattattactgcagctcatatacaggcagcagcactcgtagggttttcggacggtacgggaccaaggccgtaggtacccggttacccgttaagggttacccgacggaccccgaaacgggtcctacccggtcccccccgttcgggttaccccg

SEQ ID NO: 151235 - DNA, 519 bp, Homo sapiens
  misc_feature: GYAE6OF02F0MUJ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggcttcagggtttccaatcgcttctctgctcagtctgcgacacgcctccctgaccatctctggctccgaggctgaagacgaggctgattattactgcagctcatatacgaggcagcacgcactcgtaggtttcggacggacgggacaagcgtacgaccggtaccgtacggtcacggacccgaacggcctccgcccccgtggtacccg

SEQ ID NO: 151236 - DNA, 506 bp, Homo sapiens
  misc_feature: GYAE6OF02GB3C0.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcagggtttccaatcgcttctctggctcaagtctggcgacacggcctccctgaccatctctgggctccaggctgaagacgaggctgattattactgacagctcatatacaggcagcagcactcgtaggtttcggcggagggaccaagctagaccgtcgtacgtcacgcccgaaggctcgcccctcggtacc

SEQ ID NO: 151237 - DNA, 674 bp, Homo sapiens
  misc_feature: GYAE6OF02IL92T.7.5.A05.1.454.CMB.1.raw
tcagcgtgtctctacacgaccggtgctcgatttagatagatagacagggggggtcgtcgaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccacactgacttgctggttataatatctctcctggtatcaacaataccaggcaaagcccccaaagtcatcatttatgatgtctataatcggaccttcgtagggtttcccaattcgcctttctccttggccttccgaaagttccgttagggtccgaacgaccgggtaccccttccctcgtacccgtacttccttaccgttcggggtccttcccggaacggtccgttaggaaacgaccggaggtccgtagtaactttattacgtacgtaccgagtcctacgtacttaacttaacgacggtacgaacgctaacgcgttaacctacggttaacgggttttccggggccgtaacggggtaacccaacgggaccttcgggaacccgttaccgttaacgggtaccaacccggtacccggaaaccggtccggtacccggtacccccccgttcgggttaaccccg

SEQ ID NO: 151238 - DNA, 577 bp, Homo sapiens
  misc_feature: GYAE6OF02IU1C3.7.5.A05.1.454.CMB.1.raw
  modified_base (249)..(249): a, c, t, g, unknown or other
  misc_feature (249)..(249): n is a, c, g, or t
  modified_base (371)..(371): a, c, t, g, unknown or other
  misc_feature (371)..(371): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttataaatntctctcctggtatacaacaactaccaggaccaaacgccccaaagtcatctatttatgatgtactataactcggtccttcgtacgggtttccaatcgtcttctcgtggctccagtctggcacnccggcctccctcgacctatcctcgtcggcctcgagcgtaggaacgcggaggtctacgtaatttacttactgactcgtactctaatactacgacggcagacagacctactcggttaggttcgggacgggacggaccgtacggtctacggaccgttaccgtaggtaccgacggaccgaacggtccctaccggtccccgtacgtacccg

SEQ ID NO: 151239 - DNA, 544 bp, Homo sapiens
  misc_feature: GYAE6OF02IHZ0H.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcactggaaccacactgacgttgctggttataaatatctctcctggtatcaacaatacccaggcaaagacccccaaagtcatcatttatgtatgtctaataatcggtccttcagggtttcaatcgtcttctctgctccaagtctggcgacacggcctcctgaccatctctgggctcagctgaagcgaggctgatttatacgtgcagctacatatacgagcagcagcactcgtacgggttttcggacgggagggaccacggaccgtacggtacccggtaccgttacggtccgacgacccgtaacggtcctacccggcccccgtaccggttacccg

SEQ ID NO: 151240 - DNA, 507 bp, Homo sapiens
  misc_feature: GYAE6OF02GIEXT.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcagcagcactcaggttttcggcggagggaccaaggctagaccgtcctaggtcagcccaaggcctcgccccctggtacc

SEQ ID NO: 151241 - DNA, 528 bp, Homo sapiens
  misc_feature: GYAE6OF02IYDGR.7.5.A05.1.454.CMB.1.raw
  modified_base (241)..(241): a, c, t, g, unknown or other
  misc_feature (241)..(241): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaccaccactgacgttgctggttanaaatatctctcctgtatcaacaataccaggcaaagcccccaaagtcatcatttatgtatgtctataatcggccttcagggtttcaatcgctctctgctccagtctggcacacggcctccctgaccactctcgtgggcctccgaggctagaacgacgaggctgattagttactgacagctcatatacagcagcagcactcgtaggtttcggacggagggacaacggtcgtacgtaccgtccgtaggtaccacggtccccgaaggtctcccggtcccccgtcggtaccc

SEQ ID NO: 151242 - DNA, 627 bp, Homo sapiens
  misc_feature: GYAE6OF02IR66W.7.5.A05.1.454.CMB.1.raw
  modified_base (248)..(248): a, c, t, g, unknown or other
  misc_feature (248)..(248): n is a, c, g, or t
  modified_base (450)..(450): a, c, t, g, unknown or other
  misc_feature (450)..(450): n is a, c, g, or t
tcagcgtgtctctacacgaccggtgctcgatttagatagatagacaggggggggggtctcaggaggcagcgctctcgggacgtctccaccatggcctgggctctgctattcctcacccctcctcactcagggcacagggtcgtgggcccagtctgccctgactcagcctgcctccgtgtctgggtctcctggacagtcgatcaccatctcctgcactcggaaccaccactgacgttgctggtataatntctctcctgtatcaacaactaccagacaaacgcccccaaagtcatactatttatgtatgtctaataatcggtccttcgtacgggtttcctaatcgtcttctcgtcggctacaacgtcgtcggcgaccgaccggccctccctcgacctacttctcgtcggtcctcgaggctaggaagacgaggtctaggtatttaacgttacngactagtcctacattaagtaaccgaggaccacgcgtaagacccttaccggttacgtacgggttttaccgggaccgggtacgggaacctaacgggtcgttaccggtacccggttccgttacgggtaccaaccggtaacccggtacggacccgtcccggtaccccccgttcgggtaccc

SEQ ID NO: 151243 - DNA, 619 bp, Homo sapiens
  misc_feature: GYAE6OF02HBHVC.7.5.A05.1.454.CMB.1.raw
  modified_base (304)..(304): a, c, t, g, unknown or other
  misc_feature (304)..(304): n is a, c, g, or t
  modified_base (462)..(462): a, c, t, g, unknown or other
  misc_feature (462)..(462): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgaccgttgcttggttaataatatctctcctggtatcaacaataccagacaaacgcccccaaagtcatcatttangatgtactataatcgtcttcgagggtttccaatcgtcttctctggctacagtcgtggcgacgaccggtccctcccgtcgaccctactctcgtcgggcctccgacggctaggaaacgacggaggcgttagtactttaattactcgcagtcttacattanaccgtaggcagacacgctacgtacggttacgggtttcggacgggtaacgggaccgtaacggtccgttaaccggtaccccggttaccggttaacgggtacccgaccgggtaccccgtaacggtacccggtcccggtaccccccggtacggttaccccc

SEQ ID NO: 151244 - DNA, 571 bp, Homo sapiens
  misc_feature: GYAE6OF02F4NLJ.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaatacccaggcaaagcccccaaagtcatcatttatgatgtctataatcggcttctaggggtttccaatcgcttctctggctcaagtctggcgacacggcctccctgacccatcctcgtgggcctccgaggcctaggaacgacggaggtcgtaggtaatttagttactgcgagctacgattataacgaggctagacagacctactcgttagggttttccgggacggtacgggaccaagggtcctcggaacccggttccgtaaggtccgacggcccgaaagggtcctccggcccccgttcgggtaccc

SEQ ID NO: 151245 - DNA, 609 bp, Homo sapiens
  misc_feature: GYAE6OF02HWALJ.7.5.A05.1.454.CMB.1.raw
  modified_base (309)..(309): a, c, t, g, unknown or other
  misc_feature (309)..(309): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactcggaaccacactgacgttgcttggttaataatatctctcctggtactacaacaactaccaggacaaacgcccccaaagtcatctatttatagatntctataatcggtcttcgtacgggtttaccaatcgtcttctctgtctccaagtctcggcgacgaccggtccctcccgtacgacctacgtctacgtcgggtcctccgtacggtcgtaggaacgtacggaggctaggtaattaacgttacgtagacgacgtctactacttaaacgttacgaggacgaacgtcgaacgctaccgtacgttacgggtttcggacgggacggaccgtacggccgtacggtaccggtccgtacggtccgacggtacccgacggtcccgtccgtccccgtcgtacccg

SEQ ID NO: 151246 - DNA, 529 bp, Homo sapiens
  misc_feature: GYAE6OF02INL3P.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaataccaggcaaagacccccaaagtcatcatttatgatgtctataatcgcttcgagggtttccaatcgcttctctgctcaagtctgcacacgcctccctgaccatctcgtggctccgaggctagaagacgaggtctaggattattactgcagctacatatacgaggcagcagctacgtctaggtttcgacggacggacctacggctacgtaccgtaccgtacggtaccgtacgacccgtacggacctccgtcccccgtagtacccg

SEQ ID NO: 151247 - DNA, 679 bp, Homo sapiens
  misc_feature: GYAE6OF02I9HGI.7.5.A05.1.454.CMB.1.raw
  modified_base (250)..(250): a, c, t, g, unknown or other
  misc_feature (250)..(250): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaaatntctctcctagtatacaactaactaccaaggacaaacgacccccaaagtcaatactattatagtatagtactaataacgtcggtaccttacgtacgggtttcctaagttccgtcttctcgtggacctactaagtcgtggaccgacgaccggcccttacccgtcgaccctacgtccttcggtcggtccgtaccgacggtacgtaggaaacggtacggaggtacgtaagtaactttaacgttacgtacgtacagtactactaacttaatacgaacggacgacgacgtaacgacgtaacgtaccggttacgggttttaccggggaccggggtacgggaaccgtaacggtaccggtacggtaacccggtaccgttaccggtaccggaccgtacccggtaaccggtaccgtacccggtaccccgttccggtaccc

SEQ ID NO: 151248 - DNA, 531 bp, Homo sapiens
  misc_feature: GYAE6OF02HHBD2.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaacaataccaggcaaagcccccaaagtcatcatttatgatgtctaataatcggccttcgaggggtttccaatcgtcttctctggctcaagtctggcgacacggccctccctgaccactctcgtcggctccaggctgaagacgaggctgattattacgtgacagctacatatacaggcagcagcactcgtaggtttcggacggagggaccgagcgtacgaccgtaccgtacggtcacggcccgaacggcctccgtcccccgtggtaccc

SEQ ID NO: 151249 - DNA, 516 bp, Homo sapiens
  misc_feature: GYAE6OF02F8V0D.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgcttcaggggtttccaatcgcttctctggctcaagtctggcgacacggcctccctcgaccatctcgtcggctccgaggctgaagacgaggctgattattactgcagctcatatacaggcagcagcactcgtaggtttcggcggaggaccaaggctacgaccgtcgtaggtacacgccgaacggcctcggtcccccgtgtacccg

SEQ ID NO: 151250 - DNA, 536 bp, Homo sapiens
  misc_feature: GYAE6OF02JFA78.7.5.A05.1.454.CMB.1.raw
  modified_base (447)..(447): a, c, t, g, unknown or other
  misc_feature (447)..(447): n is a, c, g, or t
  modified_base (503)..(503): a, c, t, g, unknown or other
  misc_feature (503)..(503): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaacgcccccaaagtcatcatttatgatgtctataatcggccttcgagggtttccaatcgcttctctgctccaagtctggcgacacggccctcctgaccatctcgtgggcctccaggctaggaacgacgaggctgtaattattacgtgacagcttcaatataacgagtacngcagcctatcgtaggtttcggcgtagggaccaggcgtaccgacgtcctaggtaccncgtaccgaacggccgtccgaccccgtcggtacc

SEQ ID NO: 151251 - DNA, 550 bp, Homo sapiens
  misc_feature: GYAE6OF02HX0OY.7.5.A05.1.454.CMB.1.raw
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttaataaaatatctctcctggtatcaacaactaccaggcaaacgcccccaaagtcatctatttatgattgtctataatcgtccttcgtagggtttccaatcgcttctctgtctcaagtcnggcgacacggccctcctcgaccactctcgtgggtctccgaggctaggaacgacggaacggcttagtattaacttactgcagtctcatanacgaggcagcagcactgtacggtttcgggacggtaggaccaaggctacggtaccgtccgttacggtcacggacccgaaggtcctccggccccctggtaccc

SEQ ID NO: 151252 - DNA, 545 bp, Homo sapiens
  misc_feature: GYAE6OF02IN22W.7.5.A05.1.454.CMB.1.raw
  modified_base (369)..(369): a, c, t, g, unknown or other
  misc_feature (369)..(369): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaaacaatacccaggcaaagcccccaaagtcatcatttatgatgtctataatcggccttcagggttcaatcgcttctctggctccaagtctggcgacacggcctcccngaccatctctgggctcaggctagaagacgaggctagtattattactgcagctacatatacaggcagcagacactctagggttttaccggacgggtacgggaccaaacggcttacggacccggttccgtacggtacgacggacccaaagggccctacgggtccccccgtcggtaccc

SEQ ID NO: 151253 - DNA, 531 bp, Homo sapiens
  misc_feature: GYAE6OF02F548L.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacgcctccctgaccatctcgtgggcctccgaggctagaagacgaggctgattattactgcagctcatatacgagcagcagcactcgtaggtttcgggacggagggaccaggtccgtacggacccgttccgtacggtcgacgcccgaacggcctcccggccccgtcggtacccg

SEQ ID NO: 151254 - DNA, 555 bp, Homo sapiens
  misc_feature: GYAE6OF02FW137.7.5.A05.1.454.CMB.1.raw
  modified_base (337)..(337): a, c, t, g, unknown or other
  misc_feature (337)..(337): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctggtatcaacaatacccaggcaaagcccccaaagtcatcatttatgatgtctataatcggccttcaggggtttccaatcncttctctggctccaagtctggcgacacggcctcctgaccatctctggctcagctgagacgaggctgattattactgcagctcatatacaggcagcagcactacgtaggttttcggacgggtacgggaaccgtaacggcgtacggtacccggttcccgttacgggttccgacggtaccccgaacgggtccgtcccggtccccccgttccggttaccccg

SEQ ID NO: 151255 - DNA, 515 bp, Homo sapiens
  misc_feature: GYAE6OF02G1CZO.7.5.A05.1.454.CMB.1.raw
  modified_base (413)..(413): a, c, t, g, unknown or other
  misc_feature (413)..(413): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctggtatcaacaataccagcaaagcccccaaagtcatcatttatgatgtctataatcggccttcagggtttccaatcgcttctctgctcagtctgcgacacggcctcctgaccatctctgggctccaggctgagacgaggctgattatatgcagctcatanacaggcagcagctactcgtaggttttcggacggacgggaccaggctcggaccgtacgtacggtcgacggacccgaacggccgtaccgcccccgtcggtaccg

SEQ ID NO: 151256 - DNA, 738 bp, Homo sapiens
  misc_feature: GYAE6OF02FF3GW.7.5.A05.1.454.CMB.1.raw
  modified_base (190)..(190): a, c, t, g, unknown or other
  misc_feature (190)..(190): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctccnggacagtcgatcacatctcctgccactggaaccaccagtgacgttgccttaggttaataaatntccttctcctggtatccaacaatacccaggcaaaccgcccccaagtcatcatttangtatgtactattaacgtccggccttacgtacggggtttacctaacgttcgcctttctcgtgggtcctacctaaggtccgtcggaccgaccgaccggtaccccttacccgtcgaccctaactccgtcgtacgggtcctaccgtacgggcgtacggtaaacggaccgtacgggtacctaggtaactttacttaaccgtacgtacgtacggtaccttacaacgttaacgttacggaacgggttccaacggtaccgaacggtacccgtaaccgtttacgggttacggggttttaccggggaccgggttacggggaaccctaacgggtcccgttaccgggtaacccgttaccccggtttaacgggaccctaaccgggaacccccgaaaggggttcccctacccgggtacccccccgtttacgggttaacccccc

SEQ ID NO: 151257 - DNA, 530 bp, Homo sapiens
  misc_feature: GYAE6OF02IZWLQ.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttataaatntctctcctggtatcaacaatacccaggcaaagccccccaaagtcatcatttatgatgtctataatcggccttcgagggtttccaatcgcttctctggctccaagtctggcgacacggcctccctcgaccatctcgtggctccgacggctagagacgaggctgattattactgcagctcatactacgagcagcagcactcgtaggtttcggacgggacggaccgagtcacgtacccgtaccgtacggtacacggcccgaaggcctcggcccccgtcggtaccc

SEQ ID NO: 151258 - DNA, 532 bp, Homo sapiens
  misc_feature: GYAE6OF02GB03V.7.5.A05.1.454.CMB.1.raw
  modified_base (304)..(304): a, c, t, g, unknown or other
  misc_feature (304)..(304): n is a, c, g, or t
  modified_base (427)..(427): a, c, t, g, unknown or other
  misc_feature (427)..(427): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaacaatacccaggacaaacgcccccaaagtcatcatttangatgtctataatcgccttcagggtttcaatcgcttctctggctcagtctggcgacacggcctcctcgacctatctcgtggcctccaggctagaacgacgaggctagattattactgacagctnataatacgaggcagcagcactcgtagggtttcggcgggtaggaccaacggtctacggtcccgtaccgtaggtccacgacccgagtccgtcgtccccgtggtaccc

SEQ ID NO: 151259 - DNA, 532 bp, Homo sapiens
  misc_feature: GYAE6OF02FNBBD.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagcccccaaagtcatcatttatgatgtctataatcggcttcaggggtttccaatcgcttctctggctcaagtctggcgacacggcctccctgacccatctctcgggctccgaggctagaagacgaggctgaattattactgcacgctcattataccaggcagcagcactcgtaggtttcggacgggagggaccgaagctcggacccgtccgtaggccacggcccgaaaggcccgtccggacccccgtggtaccc

SEQ ID NO: 151260 - DNA, 558 bp, Homo sapiens
  misc_feature: GYAE6OF02IL44R.7.5.A05.1.454.CMB.1.raw
  modified_base (428)..(428): a, c, t, g, unknown or other
  misc_feature (428)..(428): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaagccccaaagtcatcatttatgatgtactataatcggccttcgtagggtttccaatcgcttctctgctcaagtcgtgcgacacgcctccctgaccatctcgtggcctccgaggctgaagacgaggtctagattattactgcagctacattanacaggcagcagcctacgtcgttacgggttttccgggacggtacgggaacccaggtcgtacgtacccggttaccgtacggtacccgacggacccgtaacggcccgtcccggtccccccgtcggttaccccg

SEQ ID NO: 151261 - DNA, 523 bp, Homo sapiens
  misc_feature: GYAE6OF02FXVZ9.7.5.A05.1.454.CMB.1.raw
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccagcaaagcccccaaagtcatcatttatgatgtctataatcgccttcagggtttccaatcgcttctctggctccagtcnggcgacacgcctcctcgaccatctcgtcggctccgngctgaagacgaggcgtagattattactgcagctcatatacgagcagcacgctactacgtaggttttcggacgggacggacgagtcgtacgaccgtccgtaggtccacgaccgacggcctccgtccccgtcgtacccg

SEQ ID NO: 151262 - DNA, 508 bp, Homo sapiens
  misc_feature: GYAE6OF02I9IPO.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccagcaaagcccccaaagtcatcatttatgatgtctataatcgccttcagggttccaatcgcttctctggctcagtctggcgacacgcctccctcgacctatctcgtggcctccgagctgaacgacgaggctgtattattactgcagctcatatacagcagcagcacgtctaggtttcggcggacggacgacgtctacgtaccgtcgtacgtcgacgacccgagctccgccccgtcgtcc

SEQ ID NO: 151263 - DNA, 617 bp, Homo sapiens
  misc_feature: GYAE6OF02H2MB5.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccacactgacgttgctggttataaatatctctcctggtatcaacaatacccaggcaaacgcccccaaagtcatcatttatgatgtctataatcgccttcagggtttcaatcgcttctctggtctcaagtcgtggcgacaccggcctccctcgaccattcctcgtgggtcctcccgtaggctaggaaagaccggtacgggcctaggtaactttaagttaccgttagtaccgtacgtactactaaattaactaaccgtagggaccaacggacaacgacctaccgttacgtacgggttttaccgggacgggtaccgggaaccgtaacggtccgtaccggtaccggtccgttaacggtccgacgacccgacggtacccgtcggtcccccctcgggttacccc

SEQ ID NO: 151264 - DNA, 707 bp, Homo sapiens
  misc_feature: GYAE6OF02JZRAJ.7.5.A05.1.454.CMB.1.raw
  modified_base (251)..(251): a, c, t, g, unknown or other
  misc_feature (251)..(251): n is a, c, g, or t
  modified_base (331)..(331): a, c, t, g, unknown or other
  misc_feature (331)..(331): n is a, c, g, or t
tcagcgtgtctctacacgaccggtgctcgatttagatagatagacagggggggtcgtcgaggaggcgagcgctctcgggacgtctccaccatggcctggctctgctattcctcaccctcctcactcaggcacgagggtcgtgggcccagtctgccctgactcagcctgcctccgtgtctgggtctcctggacagtcgatcaccatcctcctgcatcggaaacccacacttgacgtttcgaccttggttaanaaaattactcttcttcctagggtacttctaaacaacttaacccacggacaaacgacccccaaagtacactactattagtnatcgttactaataacgtccggtacctttacggtacggggttttaccaacgttccgtctttctaccttgtccttactaaacgttcgttacggacgtaccaaccgggtccctaccgtaccggtaccacgtttccttacggtccggtcttaccgcggtctacggaacggtaaccgtacggaccttagtaacgttaatttaccgtaacgtacgtacgtaactccgtaattaacccgttagaccgagtacgacgtaacgactaccgtacgtacggggttttcgaccggggtacggtaaccgtacggtaccggtacgtaccgtacccgttacggacgtaccgacccgtaacgggtcccaccggtaccccgttacggtacccg

SEQ ID NO: 151265 - DNA, 506 bp, Homo sapiens
  misc_feature: GYAE6OF02HBUXN.7.5.A05.1.454.CMB.1.raw
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaataccagcaaagcccccaaagtcatcatttatgatgtctataatcgcttcggggttcaatcgcttctctgctccaagtctggcgacncggcctccctgaccatctcgtgggctccgaggctgaagacgaggctgattattctgcagctacatatacgagcagcagcactcgtaggtttcgcgggaggaccagcgtcggaccgtcgtaggtcacgccgaaggcctcgcccctggtcctaccg

SEQ ID NO: 151266 - DNA, 575 bp, Homo sapiens
  misc_feature: GYAE6OF02JFGJL.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaatacccaggacaaacgcccccaaagtcatcaatttatgatgtctataatcggccttcgacgggtttccaatcgcttctctgctccaagtctggcgacacggtccctccctgacccatcctcgtcgggtcctccgaggtcctagaaggacgaggtctagtaattattactgcacgctacatatacgagcagcagcctagtcgtacgggtttcgggaccggtagggtaaccaaggtccgtacggtaccgttaccgtacggttaccaccggacccgtaacggtccctacccggtcccccgtccggttacccg

SEQ ID NO: 151267 - DNA, 676 bp, Homo sapiens
  misc_feature: GYAE6OF02GU579.7.5.A05.1.454.CMB.1.raw
  modified_base (552)..(552): a, c, t, g, unknown or other
  misc_feature (552)..(552): n is a, c, g, or t
tcagcgtgtctctacacgaccggtgctcgatttagatagatagacagggggggggtctcaggaggcagcgctctcgggacgtctccaccatggcctgggctctgctattcctcaccctccctcacctcgaggcacgtagggtcggtcgggcccagtctcgccctgacctcacgcctcgccctccgtgtcgtcggtcctccgtggactagtcgactccacctatcctctcgactacgtacggaacccacctacgtcggtacgttcgtcgttaggttaaataaattctccttccttccgtggtactacaaactaacctaccgagacaaaccgaccccaaagtcactactatttactagtatcgttactaataacgtccgtccttacggtacgggtttaccacgtccgtcttctcgtcggctacgtagtcgtggcgacgccgtccctccgtcgacctacttcgtcgtcggtcctcgaggctaggaacgacgacgtctagtattacttacgtcgacgacgtctactaactacgtaaccgaggtactacgacgtacnccgtaccgttacggttacggggtttaccgggccggaacggtaccgaacggtcgtaccggtacccggttcgtaacggtccgaaccggtacccgtaccggtccctcccggtccccgtcggtacccc

SEQ ID NO: 151268 - DNA, 604 bp, Homo sapiens
  misc_feature: GYAE6OF02FQPRX.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggcctcaagtcgtggacgacgacggccctcccgtcgacctactcgtcgtcggtcctccgaggcgtaggaacgacggaggtctagtattacttactcgcacgtctacattactacgaggactagacgacgtacgtacttcggttacggttttcggggaccggtacgggaacctaacggtccgtaaccggtaccccggttaccggtacggtaccgaacgaccccggtaacggtccccgtcccggtaccccccgttcggttaccccg

SEQ ID NO: 151269 - DNA, 531 bp, Homo sapiens
  misc_feature: GYAE6OF02F8HCK.7.5.A05.1.454.CMB.1.raw
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaactacccaggacaaacgcccccaaagtcatcatttatgatgtctataatcggccttcgagggtttccaatcgcttctntgctcagtcngcgacacggcctcctgaccatctcgtcggctccgagcgtagaagacgagctgtattattactgcagtctacatatacgagcagcacgcactcgtaggttttcggacgggtacgggacaacggctacggaccgtccgtacggtcgacgccgaacggccgtccggtcccccgtcggtaccg

SEQ ID NO: 151270 - DNA, 520 bp, Homo sapiens
  misc_feature: GYAE6OF02INKR7.7.5.A05.1.454.CMB.1.raw
  modified_base (246)..(246): a, c, t, g, unknown or other
  misc_feature (246)..(246): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggtataaatntctctctggtatcaacaataccaggcaaagcccccaaagtcatcatttatgatgtctataatcggcttcagggtttccaatcgcttctctgctccaagtctggcgacacggcctccctgaccatctcgtggcctcgagctgaagacgaggctagtattagttactgcgtagctacaatactacgaggcagacagctactcgtaggtttcggacggaggaccgagtctacgaccgtcgtacgtcgacgccgaacggtcgtccgccccgtggtacc

SEQ ID NO: 151271 - DNA, 535 bp, Homo sapiens
  misc_feature: GYAE6OF02IJ4L3.7.5.A05.1.454.CMB.1.raw
  modified_base (300)..(300): a, c, t, g, unknown or other
  misc_feature (300)..(300): n is a, c, g, or t
  modified_base (385)..(385): a, c, t, g, unknown or other
  misc_feature (385)..(385): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttangatgtctataatcggccttcagggtttccaatcgcttctctggctccagtctggcgacacggcctcctgaccatctctggctccngctgagacgaggctgattattactgcagctcatatacgaggcagcagcactcgtacgggttttcggcgggacgggaccgaacggcgtacgtacccggtccgtaggtaccgacgacccgtaacggccgtaccgtcccccgtacggtacccg

SEQ ID NO: 151272 - DNA, 615 bp, Homo sapiens
  misc_feature: GYAE6OF02JT898.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaataccaggcaaacgcccccaaagtcatacatttactgattgtctaattaatcggtccttacgtaggggtttaccaatccggtctttcctcgtggccttacctaagttccgtgggaccgtacaccgggccctccctcgaccctatcctccgtgggtcctcgacggtaccgtagaaacggacggacggtctacggtaatttacgttaactcggtcgtaacgtctactactagtaacgagtacgaacgcgacgactacgtacgtacgggtttcgggaccggacggaccgaaggtccgtcgtaaccggtcttacggtcaccggacccgaacggcgtaccgtcccgtccggtaccc

SEQ ID NO: 151273 - DNA, 520 bp, Homo sapiens
  misc_feature: GYAE6OF02G8INE.7.5.A05.1.454.CMB.1.raw
  modified_base (297)..(297): a, c, t, g, unknown or other
  misc_feature (297)..(297): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggcaaagcccccaaagtcatcatttangatgtctataatcgtccttcgagggtttccaatcgtcttctctggctcaagtctggcacgacgcctcctgaccatctctgggctccgaggctagaagacgaggctgattattacgtgcagctcatatacgagcagcagcacgtctaggtttcggacggtacgggaccaagcgtacgaccgtcgtacggtcgacgcccgaacgcctccgtcccccgtggtaccc

SEQ ID NO: 151274 - DNA, 636 bp, Homo sapiens
  misc_feature: GYAE6OF02JFX2P.7.5.A05.1.454.CMB.1.raw
  modified_base (254)..(254): a, c, t, g, unknown or other
  misc_feature (254)..(254): n is a, c, g, or t
  modified_base (525)..(525): a, c, t, g, unknown or other
  misc_feature (525)..(525): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgacactggaacccaccactgtacgttgcttaggttaataaatntctctcctgtatacaacaactaccaggaccaaacgacccccaaagtctaatactatttatgtatgttactaataagtcggtaccttcgtagggtttaccaattccgtctttctcgtacgtcctactaacgtcgtcggaccgacgacccggtcctacccgtacgacctatcctcgtcgggccctaccgaggtctacggaaacggaccggtaggtctagtaatttacgttaacgtcacgtacgtctactaacgtaactaaccggagaccgaanaccgagaccttacgtcggttaacgggtttccgggacgggacgggaacaacggtcgtacgccggttacgacggtccaacgccgtaacgccgtacccgtcccggtccggtacc

SEQ ID NO: 151275 - DNA, 501 bp, Homo sapiens
  misc_feature: GYAE6OF02GVLTZ.7.5.A05.1.454.CMB.1.raw
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaagccccaaagtcatcattatgatgtctataatcgccttctagggtttcaatcgcttctctgctcagtctgcgacacgcctcctnaccatctctggctcacggctagaagacgaggctgtattattatacgcanctcatatacagctagcagctactctaggtttcgacggacggacaagcgtacgaccgtctacgtcacgaccgaggcctcgccccgtgtcccg

SEQ ID NO: 151276 - DNA, 550 bp, Homo sapiens
  misc_feature: GYAE6OF02IQHO4.7.5.A05.1.454.CMB.1.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgaccgttgctggttataaatntctctctgtatcaacaataccaggacaaacgccccaaagtcatctatttangtatctactataatcggccttcacgggtttacaatcgtcttctctcggctacgagttctggacacgacggtcctccctgacctatcgtcgtcggcctcgaggtctagaagacggacggtacttagatttattacgtgcacgctacgattanacgnganacgcacgctacgtacgtacggtttacggcggagtaccgagtacctcgaccgtaccggtagtccacgccgagtccacccgtcccgtacgtacc

SEQ ID NO: 151277 - DNA, 738 bp, Homo sapiens
  misc_feature: GYAE6OF02HVFJG.7.5.A05.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttanaaatntctctcctggtatcaacaatacccaggacaaagcccccaaagtccaatcatttatgatgtctaataatcggccttacgagggtttccaatcgtcttactctcggtactcctaacgtcgttcggacgaccgtaccggcccttccctaggaccccgtaattccgttacgttcggggtcccttaccgacgggtcctaggtaaacggaccggtaacgggtccttaggtaactttagtttaacccgttaggacctaacggtccttaccgtaacttaacgtaaccgtaagggtccgaacggtaccgtaacggtaccctaaccggtttaccggttaacgggggtttttccgggaacccggggtaacggggtaacccgtaacgggtaccgttaccgggtaacccccggtttaccggttaaccggggttacccgtaaccggttaaccccggaaagggttcccccggtaaccggttccccccccgttacggggttaccccc

SEQ ID NO: 151278 - DNA, 686 bp, Homo sapiens
  misc_feature: GYAE6OF02IXU5B.7.5.A05.1.454.CMB.1.raw
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttaggttataaatntctctcctgtatcaacaataccagacaaacgaccccaaagtcatactatttacngtactgtactaataactcggtccttacgacgggtttccaattcgtcttctctcggcctacaagttcgtggcgtacgaccgtcctcccgtcgacctactcgtcgtacgggtcctaccgacggtctacggaaagtaccggacgtactacggtaatttaacgttactacggacacgtcctacgtaacttaacgtaaccggtaacggtacgaacgtacgaacggtacctaaccgttaccgttaacggggttttaccgggaccggggtaacgggtaaaccctaacgggtccggttaaccggaacccggtttaccggtacgggttaacccgacggttaccccggtaaacggtccccgtaccggttacccccccggttagggttacccc

SEQ ID NO: 151279 - DNA, 519 bp, Homo sapiens
  misc_feature: GYAE6OF02I2PZB.7.5.A05.1.454.CMB.1.raw
  modified_base (248)..(248): a, c, t, g, unknown or other
  misc_feature (248)..(248): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatntctctcctgtatcaacaataccaggacaaacgcccccaaagtcatcatttatgatgtctataatcgccttcagggtttcaatcgcttctctgctcaagtctggcgacacgcctccctgacctatctcgtcgggctccgaggctgaagacgaggctgattattacngcatcnatanacgagcagcagcactcgtagggtttcggcggacggaccaacggcgtcgaccgtccgtagtcgacgacccgaaggtcctccggtcccctcggtaccc

SEQ ID NO: 151280 - DNA, 728 bp, Homo sapiens
  misc_feature: GYAE6OF02JA7TR.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctctgtatcaacaactaccaggacaaacgacccccaaagtcatctattatgatgtactaataactcggtccttcgtacggggtttaccaagttccgtctttacctcgtggtccttaccgaagttccgtcggtacgacgaccggtccctcccgtacgacctacttcctacgttcggggtccctaccggacgggtccgtaacgggtaacggaccggtaagggtccgttaacggttaactttaaccgtttaacgttacgggtacaacggtcttaccaattaacgtaacggtacggtacgacgacacggtacctaccgttacggttaacgggttttaccggggacggggtaccgggaacccgtaaaccgggtccgttaacccggtaacccgggttaccggttaaccgggtaaccggacccgggtacccggtaaaccgggtccgttacccccgggttaccccccggtaccggtttaaccccgg

SEQ ID NO: 151281 - DNA, 605 bp, Homo sapiens
  misc_feature: GYAE6OF02FGDL7.7.5.A05.1.454.CMB.1.raw
  modified_base (299)..(299): a, c, t, g, unknown or other
  misc_feature (299)..(299): n is a, c, g, or t
tcagcgtgtctctacacgaccggtgctcgatttagatagatagacagggggggggtctcaggaggcagcgctctcgggacgtctccaccatggcctgggctctgctattcctcacctcctcactcagggcacagggtcgtgggcccagtctgccctgactcagcctgcctccgtgtctgggtctcctggacagtcgatcaccatctcctgccactggaaccaccactgacgttgctggttataaatatctctcctggtatcaacaatacccaggcaaacgccccaaagtcatcatttangatgtctataactcggccttagtacgggtttaccaactcgcttctctcggcctcaagtctggcgacaccggcctccctgaccctactcctcgtacgggcctaccgaggctaggaaggacggtacggtactaggtatttagttactgcacgctacattaactacaggaccagtcaagtcctaccttcggttacgggttttccgggacgggtacgggaacctaacggccgtacggacccgttaccgttacggtaccgacgtaccccggaaacggtcccgtacccggtcccccggttccggttaccccg

SEQ ID NO: 151282 - DNA, 535 bp, Homo sapiens
  misc_feature: GYAE6OF02GQJLR.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttataaatatctctcctggtatcaaacaatacccaggcaaagcccccaaagtcatcatttatgatgtctataatcggccttcagggtttcaatcgcttctctgctcaagtctggcgacacggcctccctgaccatctctggctcaggctgaagcgaggctagattattactgcagctacaatatacaggacagcagcacgtctagggtttcggacggtagggacctaaggcgtacgtacccggtaccgttacggtaccgacgacccgaacggccgtccgacccccgttggtacccg

SEQ ID NO: 151283 - DNA, 508 bp, Homo sapiens
  misc_feature: GYAE6OF02FM57V.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgcttcagggtttccaatcgcttctctggctcaagtctggcgacacggcctccctgaccatctctcgggctccgaggctgaacgacgaggctgattattactgcagctcatatacaggcagcagcactcgtaggtttcggcggtagggaccaggctagaccgtcctaggtccacgcccgaggcctcgccccgtgtcc

SEQ ID NO: 151284 - DNA, 595 bp, Homo sapiens
  misc_feature: GYAE6OF02HO0KF.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaataccaggacaaacgcccccaaagtcatcatttatgatgtactataactcggtccttacgtacgggtttaccaagttcgtcttctctggctactaagtctggcgacgacggtccctccctcgacctactctcgtcgggtcctccgagcgtaggaacgacggaggctagtattaacgttacgtcgacacgtactctaatagtacgaggacagcgagcctacgtacgtacgggtttcggacgggacgggaaccgaacggtccgtacggtacccgtacgttaacggtcgaccggacccgtaaccgggtccctccggtccccccgttggtaccc

SEQ ID NO: 151285 - DNA, 560 bp, Homo sapiens
  misc_feature: GYAE6OF02IPY07.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgaccgttgctggttataaatatctctcctggtatcaacaactaccaggacaaacgacccccaaagtcatacatttatgatgtactataagtccggccttacgagggtttacctaatcgtacttctctgtcctacctagtctggacgacgaccggtccctccctgacctactctcgtcgggctccgacggcgtagaagacgaggctagtaatttacttactgtacagctcaattataacaggcagcagcacgtacgtaagggtttcggacggaggactagctacgtacgtccgaggttccaacggacccgaaggtcctccgtccccgtgtaccc

SEQ ID NO: 151286 - DNA, 644 bp, Homo sapiens
  misc_feature: GYAE6OF02H9A8Z.7.5.A05.1.454.CMB.1.raw
tcagcgtgtctctacacgaccggtgctcgatttagatagatagacagggggggggtctcaggaggcagtgctctcgggacgtctccaccatggcctgggctctgctattcctcaccctcctcactcagggcacagggtcgtgggcccagtctgccctgactcagcctgccctccgtgtctgggtctcctggacagtcgatcaccatctcctgcactggaaccaccactgacgttgcttaggttaataaatatctctcctggtatcaacaactaccaggacaaacgccccaaagtcatctatttatgatgtactatatcgtccttcgtacgggtttccaagtcgacttctctcggtctacaagtcgtcggcgaccaccggcctaccctcgacctataccgttcgtcgggtcctcccgagtcgtaggaacgacgacggtcgtagttagttaactttacgtcgtacacggtactactaataacgtaacgacggactaacgacgtacgaccgtaaccgttacggtaacgggttttccgggacgggtaccgggtaaccgtaaggtccgtaacggtacccggtaccgttaacggaccgtaccggacccggtaacgggtcccgtacccggtccccccgtacggttaccccg

SEQ ID NO: 151287 - DNA, 802 bp, Homo sapiens
  misc_feature: GYAE6OF02G6W0K.7.5.A05.1.454.CMB.1.raw
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacagggggggtcgtcgaggaggcgagcgctctcgggacgtctccaccatggcctgggctctgctattcctcaccctcctcactcaggcacagggtcgtgggcccaggtctcgccctgactcagcctgccctccgtgtctgggtctccgtggacagtcatcaccntcctcctgcactggaaacccncatggacttgctagttaanaaatntctctctgtatacaacaactaccaggacaacgacccaagtcactcaattatagaatgtctaataactcgtcttacgtagggttacctagtacgtcttctcgtcgccgtactaagtcgtggaccgtacctaccggtcccttacccgtagtaccctacgttcctcgtccgggtactcccgtacggtacgtaggtaaccggacgtaagggtaccgtacgggttatttaacgtttaacgtacgttaccgtacgtaaccgttctaaacgttaccgttaaaccggtaacggtaccgtaaccggtacccgaaacggttccgtaaaccccggttttaccggttaaaccggggggttttttacccgggacccgggggggttaaacggggttaaccccggggtaaaaccgtaacccggtttacccggggttaaacccccggttaaccccgggtttaaccgggttaacccccgggttaaccgtaaccccccgggttaaaccggggtaccccccgtttacccgggttaaccccccccggtaccccgggttttaacccccggg

SEQ ID NO: 151288 - DNA, 689 bp, Homo sapiens
  misc_feature: GYAE6OF02GP80H.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctctgcactggaaccaccactgacgttgcttggttataaatatctctcctgtatcaacaataccagacaaacgccccaaagtcatcatttatgatgtactaataatcggtccttcgtacgggtttaccaatcgtactttctcgtggcctaccgtaacgttcgtcggaccgaccgtaccggtcccctcccgtacggaccctacttccgttacgtcgggtcctacccgagggtctacggaaacggtacggaggtacgttagtaactttacgttacgtcggactacggtacctactaacttaacgtaaccgacgggtaccgaacgacaacggtacctaaccgttacggtttaacggggttttaccggggacgggtaccggggaacctaacgggtccggttaaccggtaccccggttaccgtaaccggttaccggaaccggacccggtaaccgggtccctaccccggttacccccgtcggtaaccccg

SEQ ID NO: 151289 - DNA, 729 bp, Homo sapiens
  misc_feature: GYAE6OF02J08ZO.7.5.A05.1.454.CMB.1.raw
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
tcagcgtgtctctacacgaccggtgctcgatttagatagatagacaggggggggtcgtcgaggaggcgagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccnccactgacttgctggttaataatatctctctgtatcaacaataccagacaaacgccccaagtcatcatttcngatgtactataatccggtccttacgtacgggtttaccaagttccgactttccgtccgtttcggaccttacccgtaagttccgtagggtaccggtaaccgtaaccgggtccccttcccgtaacgacccgttaatccccgttccgtacgggtcccgttacccgacgggttaccgtagggaaacggtaccgggaacgggtcctacggttaattaccgttacgtcgtacgtacgtactactaactaacttaagaaccggcgtaacgacaaggacccttaaaccggttccggttaaggggtttttacccggggaacgggttaaccggggaaccgttaaccgggacccgtttaaccggtacccgggtaacccggtttaaccggaccgtaccggtaccccgaaccggttccggtaccccgttcccccgtacggttaccccg

SEQ ID NO: 151290 - DNA, 535 bp, Homo sapiens
  misc_feature: GYAE6OF02GAXDL.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaataccaggcaaacgcccccaaagtcatcatttatgatgtctataatcgcttcgagggtttcaatcgcttctctggctcaagtctggcgacacggcctccctgacctactctcgtgggcctccgacgggtctaggaagacggaggctgtattattactgacagctacatatacgaggcagcagcactcgtaggtttcggacggagggaccacggcgtacggaccgtccgtaggtaccgacgaccgtaacggcctccggtcccccgtgtcccg

SEQ ID NO: 151291 - DNA, 629 bp, Homo sapiens
  misc_feature: GYAE6OF02JSK6G.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaactacccaggacaaacgacccccaaagtcatacatttatgtatgtactataatcggtccttcgtacgggtttaccaagttccgtacttctctggcctccgtaagtcgtacggcgacaccggtccctccctcgacctactctcgtcgggtcctaccgacggctaggaacgacggaggtctaggtatttacttacgtcgtacacgtctacattactaacgaggaccagacacgtacctacgttacggttacgggtttacggggaccgggtacggaaccgtaacggtccgttaccgaccggttaccggtacggtaccgacggtaccccgtaacggtcccggtcccgtaccccgttaccgggttaccc

SEQ ID NO: 151292 - DNA, 622 bp, Homo sapiens
  misc_feature: GYAE6OF02G0LF9.7.5.A05.1.454.CMB.1.raw
  modified_base (249)..(249): a, c, t, g, unknown or other
  misc_feature (249)..(249): n is a, c, g, or t
  modified_base (298)..(299): a, c, t, g, unknown or other
  misc_feature (298)..(299): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcacatctcctgcactggaacccaccactgacgttgcttggttaataaatntctctcctgtatcaacaataccagcaaacgccccaaagtcatcatttannatgtctataatcgaccttgagggttccaatcgtcttctctggctcaagtcgtggcgaccgacgtccctccctacgaccctatcctcgtcggcctcacggctagaaaggtacgaggactaggtaatttacgttacgtgtacgaacgtcgtactaacggtaacttaccgacggactacgaccgtacggactaccgttacgtttacgggtttaccgggacggggtacgggaaccctaagggtccgtaacggaccccggttacggtaaccggtacgaccggtacccgaaacggtcccgtacccggtacccccgttccgttaacccgg

SEQ ID NO: 151293 - DNA, 602 bp, Homo sapiens
  misc_feature: GYAE6OF02FGLWI.7.5.A05.1.454.CMB.1.raw
  modified_base (300)..(300): a, c, t, g, unknown or other
  misc_feature (300)..(300): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccaggcaaagcccccaaagtcatcatttangatgtctataatcggccttcgtagggtttccaatcgcttctctggctccaagtctggcgacacggccttccctgacctatctctgggctcccgaggtctacggtaaagaccggaaggcgtagtactttaattactcgtcagctacaataacttacgaggtacacggtacaagtccaacttcgtaagggtttttccggggacgggtacggggaaccgaacggtcgtacggaccccggttaccgtacgggtaccgaacggtaccccgaacggccgtcccggtacccccgttccgggtaaccccg

SEQ ID NO: 151294 - DNA, 511 bp, Homo sapiens
  misc_feature: GYAE6OF02G8KAT.7.5.A05.1.454.CMB.1.raw
tcagcgtgtctctacacgaccggtgctcgatttagatagatagacaggggggggtctcaggaggcagcgctctcgggactctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggttcaatcgctctctggctcagtctggcgacacgcctcctgaccatctctggctccaggctgaagacgaggctgattattactgcagctcatatacgaggcagcagcactctagggttttcgcgggagggaccgacggtcgtcgaccgtcctacggtcacggcccaggtccgtaccgtccccgtcggtccc

SEQ ID NO: 151295 - DNA, 539 bp, Homo sapiens
  misc_feature: GYAE6OF02IPR6F.7.5.A05.1.454.CMB.1.raw
  modified_base (300)..(300): a, c, t, g, unknown or other
  misc_feature (300)..(300): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccatgacgttgctggttaataaatatctctcctggtatcaaacaatacccaggcaaacgaccccaaagtcatcattangatgtctataatcgtctcgtagggttacaatcgcttctctggctcaagtctgcgacacgcctcctgacctatctcgtcggctcgacgctagaagacgacggctagtattaattacgtgcagctacatatacgagcagcagcaacgtcgtacgggtttcggacggacgggaaccgaagtcgtacgtaccgtaccgtacggtacacgtacccgaagtccgtaccgtccccgttcgtacccg

SEQ ID NO: 151296 - DNA, 610 bp, Homo sapiens
  misc_feature: GYAE6OF02JOJTV.7.5.A05.1.454.CMB.1.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctgggtctctggacagtcatcaccatctcctgcactggaaccaccatgacgttgcttaggttaataaatntctctcctgtatcaacaactacccaggcaaacgccccaaagtatcaatttangtaatgtctataatcggtcctttacgagggtttccaatcgtcttctcgtgctacaagtctggcgacacggtcctcctgaccactctcgtcggctccgagcgtagaacgacggaggtctagtaactttattacgtctcgaagtctacaactacgtaacgtacgacgacgacgtacgacgtacttcgttacggtttaccggggacgggtaaccgggtaccgaacggtaccggtaccggtaacccgttacggtaacgtaccgtaaccggtaacccgacgggtaccgtcccgtaccccgttcggtaccctacccgg

SEQ ID NO: 151297 - DNA, 512 bp, Homo sapiens
  misc_feature: GYAE6OF02GYM25.7.5.A05.1.454.CMB.1.raw
  modified_base (334)..(334): a, c, t, g, unknown or other
  misc_feature (334)..(334): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagcccccaaagtcatcatttatgatgtctataatcgccttcagggtttccaatcgnttctctggctccaagtctggcacacggcctccctgaccatctctggctcagctgaagagaggctgattattactgcagctcatatacaggcagcagcactctaggtttcgcgggacggaccaaggtctacgaccgtcctacggtccacgcccgaaggcctccgtccccgtcggtaccc

SEQ ID NO: 151298 - DNA, 598 bp, Homo sapiens
  misc_feature: GYAE6OF02GOLRV.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggtataatatctctctgtatcaacataccaggcaaagccccaaagtcatcattatgatgtctataatcggccttcgagggtttccaatcgcttctctcggctcaagtctggcacgacgcctccctgaccatctctcggctcgaggctgaagacgaggctgtattattactgacgagtctactatacgtaacacggactagccaggtaccaacgttcgtaacgggttttccgggaccgggtaaggggaacccgtaacgggtccgttaaccgggtaaccccggttaccggttacgggtaacccgtaccggtaccccggtaaacgggtaccctttccgggttccccccggttacgggttaccccg

SEQ ID NO: 151299 - DNA, 560 bp, Homo sapiens
  misc_feature: GYAE6OF02HWOMS.7.5.A05.1.454.CMB.1.raw
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
tcagcgtgtctctacacgaccggtgctcgatttagatagatagacagggggggggtctcaggaggcagcgctctcgggacgtctccaccatggcctgggctctgctattcctcacccctcctcactcagggcacagggtcgtgggcccagtctgccctgactcagcctgcctccgtgtctgggtctcctggacagtcgatcaccatctcctgcactggaacccacactgacgttgctggttataaatatctctcctggtatcaacaataccagcaaacgacccccaagtcatcattatgatgtctataactcgtccttcgtagggttcatcgcttctctgctcagtcngcacgacgcctcctgacctatctcgtcggctcgaggctagagacgagctagattattactgcngctctatatacgaggcagcagacctacgtcgtaggggtttccggacgggacgggtaaccgaaggtcgtaccggtacccggttaccgttagggtaccctacggaccccgtaaacgggtccccgttaccggtccccccggtcggttacccg

SEQ ID NO: 151300 - DNA, 682 bp, Homo sapiens
  misc_feature: GYAE6OF02JG9OO.7.5.A05.1.454.CMB.1.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatntctctcctgtatcaacaatacccaggacaaacgccccaaagtcatcatttangatgtactataatcggcttacgagggttacaatcgtcttctctgctccaagtcgngacgacacggcctccgtgacctatcttcgtcgggtacctaccgaggtacctacggaaacgtacggagggtcctaggtaaatttacgttacgttagaccgaacggttcctacgtaattaaacggttaaccgtaagggtacccgaaaggtacccgtaacgggtaccttaaccggttacggtttaaccggggtttttcccggggaacggggaacgggtaacccgtaacggtccgttaaccggaacccggtttacccgtaacgggttaccgaaaccgggtaccccgtaaacgggttccccgtacccgggttaccccccgtacggttaccccg

SEQ ID NO: 151301 - DNA, 598 bp, Homo sapiens
  misc_feature: GYAE6OF02IIC2H.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaacccacactgacgttgcttagttataaatntctctcctgtatcaacaataccagacaaacgaccccaaagtcatactatttatgtatgtactataatcggtccttcgacgggtttaccaagtcgtctctcgtgtctccagtctggaccgtacgccggtccctcccgtacgaccctatcctcgtcgggcctacccgaggtctaggacgacgggaggcgtagtaagttacttactgactagtctacatataacgagtacagcacgcctacgtacgttacgggtttccggagggaaccgggtaccacggtccgtaccggacccggtaccgtacggaccgaccggaccgacggtcccgtacccggtcccctacggtacccc

SEQ ID NO: 151302 - DNA, 598 bp, Homo sapiens
  misc_feature: GYAE6OF02HDYJ0.7.5.A05.1.454.CMB.1.raw
  modified_base (302)..(302): a, c, t, g, unknown or other
  misc_feature (302)..(302): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactggaacccaccactgacgttgcttggttaataatatctctcctggtatcaacaactacccaggcaaacgccccaaagtcatcatttangatgtactataatcgtccttcgtagggtttccaatcgtcttctctggctcaagtctggcgacgaccggcccttccctcgaccctacttctcgtcgggtctccgaggtctagaacgacggacggtctagtatttaacgttacgtcgactagcccttataattacgtaacgacggacgtacgcagcctaacgttcgttacgggtttcggacgggacggtaccgaaggtcgtaccggacccggttcgtacggtccgaaccggcccgtaacggcccgtacccgtcccccgtgttaccccg

SEQ ID NO: 151303 - DNA, 794 bp, Homo sapiens
  misc_feature: GYAE6OF02JQ9TQ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcaccatcctcctgcactcggaacccaccactgacgttgcgtggttaactaaatacttcctccttccttaggtactcaaactaactaaccccgaggtaccaaaacggaccccccaaaagtaccaactactaacttttaatgtaacttgttacctaattaacgtccggtaccttacggttaacggggtttaccaacgttaccgtcctttccgtcgttcgggccttaccgtaaacgttccgtacgggtccgaaccgtaaccgggtccccttaccccttaccggacccctaactttccgttccggttccgggacccttacccgacgggttcctacgggaacgaacgggacggtacggtacgttaacgttaagtttaacgtcgtaccgtacgtacgttccgtaattaacgttaacgacggtaccgtacggacgacgtaccgtaacgttccggttaaccgggttttacggggaccggggtacggaacccggtaacgggtaccgttaccgggtaacccgttaccgttaccgggtaccggaacccggtaccccgggtaaaccggcccgtttaccccggtacccccgggtaccgttcccccgg

SEQ ID NO: 151304 - DNA, 522 bp, Homo sapiens
  misc_feature: GYAE6OF02HVY9P.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcgagggtttcaatcgcttctctggctccaagtctggcgacacggcctcctgaccatctctggcctccaggctgaagacgagctgattattactgcagctctatatacgagcagcagcacgtctacggttttcggcggagggaccgaaggctacgaccgtcgtacggtccacggcccgaaggcctccgtcccccgtcggtacccg

SEQ ID NO: 151305 - DNA, 585 bp, Homo sapiens
  misc_feature: GYAE6OF02JNC7R.7.5.A05.1.454.CMB.1.raw
tcagcgtgtctctacacgaccggtgctcgatttagatagatagacaggggggggtcgtcgaggaggcagcgctctcgggacgtctccaccatggcctgggctctgctattctcaccctcctcactcagggcacagggtcgtgggcccagtctgccctgactcagcctgcctccgtgtctgggtctcctggcagtcgatcaccatcctcctgcactggaaccaccactgacgttgctggttataaatatctctctgtatcaataataccagcaaacgaccccaagactactctattactgatgtctaataatcgtcttcgtagggtttacctagtcgtcttctctcgtctcagtctggtcgacacggtcctaccgcaccatctacgtcggcctcgacggctacgaacgacgaggcttacgtattattacgtcgctagtcttacgtattacgtaacagtacgacgacgacgaccgtacttaccgtagggttttccgggacgggtacggtaaccgacggtctacggtaccgtaccgtacggtaccgagtacccggaccggtcgtacccggaccccgttcggtacccgg

SEQ ID NO: 151306 - DNA, 658 bp, Homo sapiens
  misc_feature: GYAE6OF02H0UYP.7.5.A05.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcacgtggaaccacactgacgttgctggttaanaaatntctctcctgtactacaacaactacccgaggacaaacgcccccaaaagtcaatcctaatttactagtaatgtactaataagtccgtcttacgtacgggtttaccaatccgtctttactctggtcctaccgaagttcgtggaccgaccgaccggtcccttcccgtagaccctatccgtcgtcgggtcctaccggtacggtacgtagaacggtacggacggtcgtagttacttattacgtagcgacgtctacgaacttacgtaacgtaggcgaacgtaccgaacgtccgtaccgtacggttacgggtttacggggacgggtaccgggtaaccgtacgtccggttaccggtaccgtccggtacgtaccgaccgacccggaaccgtcccgtacccgtccccggttaccggtacccg

SEQ ID NO: 151307 - DNA, 545 bp, Homo sapiens
  misc_feature: GYAE6OF02FZYUZ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcatcaccatctcctgcactggaaccacactgacgttgctggttataaatatctctcctggtatcaacaataccaggcaaacgcccccaaagtcatcatttatgatgtctataatcggccttcgtagggtttccaatcgcttctctgctccaagtctggcgacacggcctccctcgacctactctcgtgggcctccgaggctaggaagacgaggctgattattactgcgagtctactatactacgagcagcagctactcgttagggtttcgggacgggacggacctaacggcgtacggtacccggtacgtacggtccgacgacccgaaggcctcccggccccgtgtacccg

SEQ ID NO: 151308 - DNA, 539 bp, Homo sapiens
  misc_feature: GYAE6OF02HAXZU.7.5.A05.1.454.CMB.1.raw
  modified_base (438)..(438): a, c, t, g, unknown or other
  misc_feature (438)..(438): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccagcaaacgcccccaaagtcatcatttatgatgtctataatcggccttcgagggttacaatcgcttctctgctcagtctggcacgacggcctcctgaccatctcgtgggctccgagctagaagacgaggtctagatttacttactgcagctcatatacgaggcagcacncactcgtaggtttcggacggtagggaccaaggtcctacggtacccggtaccgtaggtccgaacggtcccgaacggtccgtcccggtcccccgtcggtaccc

SEQ ID NO: 151309 - DNA, 654 bp, Homo sapiens
  misc_feature: GYAE6OF02H86IP.7.5.A05.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
tcagcgtgtctctacacgaccggtgctcgatttagatagatagacgagggggggggggtctcaggaggcagcgctctcgggacgtctccaccatggcctgggctctgctattcctcaccctcctcactcaggcacaggggtcgtgggcccagtctgccctgactcagcctgcctcgtgtctgggtctcctggacagtcgatcaccatcctcctgcactggaacccacacngtacgttgctggttaataaatactctcttctaggtactcaacaactaccagacaaacgacccccaaagtcaatctaatttangtatgtctaataacgtcgtccttgacgggtttccaatcgtcttctctcggtcctccaagttcgtacgccgaaccgtccggcccctacccgtacgaccctacgttcccttcgtcggggccctttacccgagggtcgtacggaaacggtaacgtacgggtccttaggtaacttttaacgttactggtaccctaagtcctctaaagttacaacgtacggacacggactaacgccgttacctacggttacgggtttacggacggggaccgaacgtacggtctaccggtaccgtccgttacggtccggaacgcccgtaacggcccgtccggtccccacggttacccg

SEQ ID NO: 151310 - DNA, 564 bp, Homo sapiens
  misc_feature: GYAE6OF02HP09H.7.5.A05.1.454.CMB.1.raw
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttataaatatctctcctggtatcaacaatacccaggacaaacgcccccaaagtcatcatttatgatgtctataatcggtccttcgagggtttccaatcgcttctcgtggtcctcaagtcgtggacgacacggccctcccngaccctatctcgtggcctcaggctgagacgaggctagtattattaactgcanctacatatacaggcagcacgcacgtacgtacgggttttcgggacggtacgggaccgaacgcgtaccggaccggttccgtaacggtcaccggtacccgtaacggccgttcccggcccccgttacggttacccg

SEQ ID NO: 151311 - DNA, 530 bp, Homo sapiens
  misc_feature: GYAE6OF02GCD45.7.5.A05.1.454.CMB.1.raw
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcaggcacagggtctgggcccagtctgccctgactcagcctgcctccgtgtctgggtctcctggacagtcgatcaccatctcctgccactggaaccaccatgacgttgctggttataaatntctctcctggtatcaacaataccaggcaaagcccccaaagtcatcatttancgatgtcgtataatcggccttcaggggtttccaatcgacttctctggctccaagtctggcgacacggtcctcccgtgaccagtctcgtcgggctccaggctgaagacgaggctgattattactgcagctcatatacaggcagcagcactcaggttttcggcggtacgggaccgaaggcctagtacccgtccgttaggctacggcccaaaggcctaccgtcccccgtcggtacccg

SEQ ID NO: 151312 - DNA, 534 bp, Homo sapiens
  misc_feature: GYAE6OF02GJLFH.7.5.A05.1.454.CMB.1.raw
  modified_base (247)..(247): a, c, t, g, unknown or other
  misc_feature (247)..(247): n is a, c, g, or t
  modified_base (517)..(517): a, c, t, g, unknown or other
  misc_feature (517)..(517): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatntctctcctggtatcaacaataccaggcaaacgcccccaaagtcatcatttatgatgtctataactcgccttgacgggttccaatcgcttctctgctcaagtctggcacacggcctccctgacctatctcgtcggcctcgaggctgaacgacgacggctagtattattactgtacagtctactatactacgaggcacgcacgacactcgtaggtttcggacggtacggacgacgctacggtaccgtccgtacggtcgacgccgaaggtccncggtcccctcggtaccc

SEQ ID NO: 151313 - DNA, 557 bp, Homo sapiens
  misc_feature: GYAE6OF02I13N6.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccacttacgtgctggttaataaatntctctcctgtatacaacaataccaggacaaacgcccccaaagtcatctatttatgatgtactataatcggtccttacgtagggtttacatcgtcttctctgtctcagtctggcgacgaccggtccctccctacgacctagtcctcgtcgggcctccgaggctaggaacgacggagtctagtacttacttactcgactagtctacatatacaggacagcagcacttcgtaggttcggacggtacggacgagtcgtacggtacctacgtacgtacgacgaccgacgtccgtcccgtcccgttcggacctccg

SEQ ID NO: 151314 - DNA, 664 bp, Homo sapiens
  misc_feature: GYAE6OF02H9B1U.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttaataaatatctctcctggtatcaacaataccaggcaaacgccccaaagtcatctatttatgatgtactataacgtcgtccttacgtagggtttaccaagtcgtcttctcgtcggtcctactaagtcgtggacgaccgaccggtccctcccgtacgacctactcctcgtcggtcctccgaggtcgtacggaacgacggtacggctacggtaatttaacgttacgtacgacgtacggtacctactaagttaacgtaaccgtaacgggtacaacggacaacgtaccttaccgtacggtttaccggggtttccgggacgggtacgggtacccgtaacgggtcgtaaccggtacccggttaccggttacggtaccggtaccggacccggtaacggtcccgtacccggtccccccgtaggtaccccg

SEQ ID NO: 151315 - DNA, 585 bp, Homo sapiens
  misc_feature: GYAE6OF02G5RA4.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctggtatcaacaataccaggcaaacgcccccaaagtcatcatttatgatgtctataatcggccttcgtaggggtttccaatcgtcttctctggctccaagtctgcgacaccggcctccctgaccatcctcgtcgggcctccgacggtctagaacgacgacggctagtattattacgtgcagtcgtactatactacgacggtacgagacacgcctaacgttacgtaacgggttttcgggacgggtacgggaaccgaacggtcgtacggtaccgttaccgtacgtaccgaaccggacccgaacgggtccgtacccggtccccgttccggtacccg

SEQ ID NO: 151316 - DNA, 571 bp, Homo sapiens
  misc_feature: GYAE6OF02J0E0A.7.5.A05.1.454.CMB.1.raw
  modified_base (249)..(249): a, c, t, g, unknown or other
  misc_feature (249)..(249): n is a, c, g, or t
  modified_base (364)..(364): a, c, t, g, unknown or other
  misc_feature (364)..(364): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatntctctcctggtatcaacaatacccaggcaaagccccccaaaagtcatcatttatgatgtctataatccgcttcgaggggtttccaatcgtcttctctggctccaagtctggcacncgtcctcctgacctatctcgtcggctccgacggctagaacgacgaggctagtattacttactgcacgtctacattagttacacggctacgcagaccacttcggtacgggttttcggacgggtacggaccgtaaggtccggtacgtaccggtaccgtacggtacgacggacccgaaggtcccgtccggtaccccggttcgtaccccgg

SEQ ID NO: 151317 - DNA, 516 bp, Homo sapiens
  misc_feature: GYAE6OF02HAT41.7.5.A05.1.454.CMB.1.raw
  modified_base (409)..(409): a, c, t, g, unknown or other
  misc_feature (409)..(409): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaatacccaggcaaagcccccaaagtcatcatttatgatgtctataatcggccttcgagggtttccaatcgcttctctgctcagtctgcacacgcctcctgaccatctctcggctccgaggctgaagacgagctgattattactgcanctcatatacaggcagcgagcacgtctagggttttcggcgggacggaccgaacggtctagacccgtacgtacggtcgacgcccgagtccgtccgtccccgtcggtccg

SEQ ID NO: 151318 - DNA, 664 bp, Homo sapiens
  misc_feature: GYAE6OF02HWOYM.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgaccgttgctggttataaatatctctcctgtatcaacaataccagacaaacgacccccaaagtcatctatttatgatgtctataactcggccttcgagggtttccaatcgcttctcgtgtcctaccaagtcgtggcgaccgacggccctcccgtcgaacccactcgtacgtcgggtcccttccgagggtcctaggaacggacgacgggtactagtaatttacgttaacttcggacgtacgtcctactaattaacgtaaccgtacgaccgtaagccgaacggaccttaccgtacggttacggggttttaccggggccgggtaacggggaaccgtaacggtccggttaaccggtacccggttaacccgttacgggtaccctaaccgggtaccccggtaaccggcccgtttaccccggccccccggttcgggtacccc

SEQ ID NO: 151319 - DNA, 852 bp, Homo sapiens
  misc_feature: GYAE6OF02HHWMR.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcacatctcctgcactggaacccacactgacgttgctgtataaatntctctcctggtatcaacaataccaggcaaacgcccccaaagtccatacctatttactgtacttcgtactaataacgttcgtacctttacgtacggggttttaccaaagttccggtactttcgtcttgggccttaccgaaacgtcctttcggacgtaccgaccggtcccttacccgtacggaacccgtaacttccttacgttccggggtccttacccgtaacggggtaccgttacggaaaccggtaaccgggtaacgggtaccttaacgggtaacttttaaacggtttaaccgttcggaaccgtacgggttaccttaacctaaacgtttaaactttaaacccggaacggggtacccgttaaacgggaccgtaaccgggtaaccgtttaaacccccgttacgggtttaaacccggggggttttttacccgggaaccggggggggtaaacccgggggtaaaccccggtaaacggggtaccccgttaaccgggttaaccccgggttaaaccccggttaacgggttacccgtaaaccccgggtaaccccggtaaaccgggtccccggtttaccccgggtacccccccggtttaacgggtttaacccccccgg

SEQ ID NO: 151320 - DNA, 578 bp, Homo sapiens
  misc_feature: GYAE6OF02G5L4T.7.5.A05.1.454.CMB.1.raw
  modified_base (446)..(446): a, c, t, g, unknown or other
  misc_feature (446)..(446): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgtctccgtgtctgggtctccgtggacagtcgatcaccatctcctgcactggaacccaccactgacgttgcttaggttaataaatatctctcctggtatcaacaatacccagacaaacgcccccaaagtcatctatttatgatgtctataatcgcttcgagggttccaatctcttctctgctcaagtctggcgacgacgccctcctcgaccactctcgtcgggcctccgaggtccgtaggaagacggaggtctagtatttaattacgttgctagtcctanatacgacgagcagcacgctacgtcgttacgggtttcgggacgggacggaccgaaggtccgtaccggtacccgtccgttacggtaccgacggacccgtaacggtcccgtacccggtccccgtcggttaccccg

SEQ ID NO: 151321 - DNA, 600 bp, Homo sapiens
  misc_feature: GYAE6OF02H53P7.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataatntctctcctggtatcaacaataccaggacaaacgcccccaaaagtcatctatttatgtatgtctataatcggtccttcgacgggtttaccaatcgtcttctctcggctcaagtctggcgacgacggcctccgtcgaccattccgtcgtcgggcctccgacggtctaggaaagacggacggcttcgtaatttaacgttacgttgactagtcctacaattactacgacggtcagacgagcctaacgtcgttacgggttttcgggacggtacgggaccaacggtccgtaccggtaccggttaccgtacggtacgacggacccgaacggtccgtacccggtcccccgtcggtacccg

SEQ ID NO: 151322 - DNA, 563 bp, Homo sapiens
  misc_feature: GYAE6OF02JEZVF.7.5.A05.1.454.CMB.1.raw
  modified_base (400)..(400): a, c, t, g, unknown or other
  misc_feature (400)..(400): n is a, c, g, or t
tcagcgtgtctctacacgaccggtgctcgatttagatagatagacagggggggtcgtcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcactggaaccaccactgacgttgctggttaataaatatctctctgtatcaacaactaccagacaaacgaccccaacgtcatctattactgatagtctaatatcggtcttcgtacgggttacctaatcgtcttctcgtcgctctatcgtgacgacgaccgcctccgctaccactctcgcggtcctcgcgtcngaagcgacgctagtattattactcacacgtctacatactacgagcacgacgacgtcgtaccttcggttacgggtttacgggacgggtacgggaaccacggtacgtacggtaccgtccgtaacggtaccacggaccctacggccgcccgttcccgacgttcccg

SEQ ID NO: 151323 - DNA, 526 bp, Homo sapiens
  misc_feature: GYAE6OF02GSAZH.7.5.A05.1.454.CMB.1.raw
  modified_base (248)..(248): a, c, t, g, unknown or other
  misc_feature (248)..(248): n is a, c, g, or t
  modified_base (332)..(332): a, c, t, g, unknown or other
  misc_feature (332)..(332): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttataaatntctctcctggtatcaacaatacccaggcaaacgcccccaaagtcatcatttatgatgtctataatcggcttcagggttccatcncttctctgctcaagtctggcgacacgcctccctgaccatctcgtggctccgaggctgaagacgaggctgtattattactgcagtctcatatacgagcagcagcactcgtacggtttcggcggtacggacgaggcgtacggtacccgtaccgtacggtacacggaccgacggccgtccgtccccgtcggtacccg

SEQ ID NO: 151324 - DNA, 720 bp, Homo sapiens
  misc_feature: GYAE6OF02GA0RI.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttggttaataaatatctctcctggtatcaacaataccaggacaaacgcccccaaagtcatcatttatgatgtactataagtcggtccttcgtacggggtttccaagtccgtcttctctggtcctacctaagtcttcggacgaccgaccggtcccttaccccgtacgaccctactccgttccgtgggtccctcccgacggtccttaacggaaacggaccggaacgggtccgttaggtaacttttactttaacgtcgtacgtacgtacctactaagttaacttaacgaacgggtacgaacgtaccgaacggtacctaaccgtttaccggttaacggggtttttcccggggaacggggtacggggtaacccgtaacgggtcccgttaccgggtaaccccggtttaccggttaaccggggttacccgaaccgggttaccccggaacggttcccttccccgggtacccccgttcccgggttaaccccg

SEQ ID NO: 151325 - DNA, 565 bp, Homo sapiens
  misc_feature: GYAE6OF02HBV1X.7.5.A05.1.454.CMB.1.raw
  modified_base (361)..(361): a, c, t, g, unknown or other
  misc_feature (361)..(361): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaacaataccaggcaaacgcccccaaagtcatcatttatgatgtctaataatcggccttgagggtttaccaatcgtcttctctggctcagtctgcgacncgcctcctcgacctatctcgtcgggctccgaggtctaggaacgacgaggctgtattattactgcagtctcaatatacgacggacagcagcctaacgtcgttacgggtttcgggacgggtacgggaccgaaggtccgtacggtaccgtaccgtacggtaccgaacggacccgtaaggcccgtacccggtcccccgtcggtacccg

SEQ ID NO: 151326 - DNA, 584 bp, Homo sapiens
  misc_feature: GYAE6OF02HCKZY.7.5.A05.1.454.CMB.1.raw
  modified_base (252)..(252): a, c, t, g, unknown or other
  misc_feature (252)..(252): n is a, c, g, or t
  modified_base (463)..(463): a, c, t, g, unknown or other
  misc_feature (463)..(463): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatcctcctgcactcggaacccaccactgacgttgcttggttaataatntctctcctggtatcaacaataccaggacaaacgcccccaaagtcatctatttatgatgtctataatcggtccttcgacgggtttcaatcgcttctctgctcagtctggcgacgaccgcctccctcgacctactcctcgtcgggtcctaccgacggctaggaacgacggacggtcgtagtatttacttacgtgacgagtacctataacttanacgtaggcagaccagcctacgtcgtacgggtttcgggacggtacggaccgaagccgtacggtaccgtccgtaacggtccgaccggaccgaccggtccgtcccggtcccccgtcggtacccg

SEQ ID NO: 151327 - DNA, 550 bp, Homo sapiens
  misc_feature: GYAE6OF02I0GSK.7.5.A05.1.454.CMB.1.raw
  modified_base (250)..(250): a, c, t, g, unknown or other
  misc_feature (250)..(250): n is a, c, g, or t
  modified_base (414)..(414): a, c, t, g, unknown or other
  misc_feature (414)..(414): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgaccgttgctggttaataaatntctctcctgtatcaacaactaccaggcaaacgacccccaaagtcatcatttatgatgtctataatcggccttcgagggtttccaatcgtcttctctggcctacagtctggcgacacggcctccctcgaccatcctcgtcggctcaggctagaagacgaggcgtnattattacgtgccagtctacatactaacgaggcagcagccacgtcgttaggtttccgggaggtacgggaccaaggtctacggacccgtcctaggtccgtacgcccgtaacggccgtcccgccccgtcggtaccccg

SEQ ID NO: 151328 - DNA, 659 bp, Homo sapiens
  misc_feature: GYAE6OF02HL07M.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgctggttataaatatctctcctgtatcaacaataccaggacaaacgcccccaaagtcatactattatgatgtactaataactccggccttcggtacgggtttaccaacgttcgtcctttcttcgtacggtcctaccgtaagttccgtacgggccgaaccgaccggtaccccttcccgtcgaaccctacttccgtcgtcgggtccctccgacggtcgtaggtaacggacggacggtactaggtaatttaacgttacgtcgactacgtctactacttacgtaacgagacgtagacacgacgtacgttacgtaccgggttttacgggaccgggtacggaaccgaacggtacgaccggtaccgttccgtaacggttccgaaccggtcccgaaacggtcccggtcccgtcccccggtcggttaccccg

SEQ ID NO: 151329 - DNA, 655 bp, Homo sapiens
  misc_feature: GYAE6OF02JVHOP.7.5.A05.1.454.CMB.1.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccacctatgacgttgctaggttataaactntcctctctgtatacaacaactacccaggaccaaacgccccaaagtcaatctatttangatgtactataatccgtcttcgtacgggtttccaatcgtaccttctcgtcggtacctaccgtaagtcgtacggacgaccgtacccggtcccttacccgtcgaaccctacgttcttaccgtcgggtacctccggaagtccgtaaggaacgacggacgggtctacgtatttacgttactcgtacgagtcctactagttaactcgtacggtacaccggtcaacgtacctacgtccgtaacgggtttacgggacggacgggtaacgtacggtacgtaccggtaccgttaaccgttacggtaccgaccggtacccggtaacgtcccggtcccgttacccccggtaggttaccc

SEQ ID NO: 151330 - DNA, 809 bp, Homo sapiens
  misc_feature: GYAE6OF02IM86B.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttggttataaatctctctcctggtactacaacaactaccaggacaaacgaccccaaagtcatctatttatgatgtactaataactcggtcctttcgtacggggttttaccaagttccgtcctttacgtccgttacggtccttaccgtaacgttccgttacgggaccgaaccgtaaccgggtcccttaccccgtacgtaccctaacgttccgttacgtcggggtccttacccggacgggtaccgtaacgggtaaacggaacgggtacgggtacttaggtaacttttaacgtttaaccgtacgtacgtaaccggtaccttaacgtaacttaaccgttaaaccggaacgggtaaccgtaacggaccgtaaacggtaccgtaaacccgttacggtttaaaccgggggtttttacccggggaccgggggtaaccggggtaaacccggtaaaccgggttacccgttaacccgggtaaccccgggtttaacccgttaacgggtttacccgaacccgggtaaccccggaaaccgggtccccggttaccccggtacccccccggttacccgggtttaaccccgg

SEQ ID NO: 151331 - DNA, 534 bp, Homo sapiens
  misc_feature: GYAE6OF02I6T3W.7.5.A05.1.454.CMB.1.raw
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctggtatcaaacaataccaggacaaacgacccccaaagtcatcatttatgatgtctataatcgccttcgagggtttccaatcgcttctctggctcaagtctggcgacacggcctccctgacctatctcgtcgggcctccgaggctaggaagacgaggctagattattactgcagctacatanacacgcagcagcactcgtaggtttcggnggtacgggaacgaagcgtacgaccgtccgtaggtcgacgcccgacggcctccggtccccgtcggtacc

SEQ ID NO: 151332 - DNA, 515 bp, Homo sapiens
  misc_feature: GYAE6OF02F6J3M.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagccccaaagtcatcatttatgatgtctataatcggcttcagggtttccaatcgcttctctggctcaagtctggcgacacggcctccctgaccatctctgggctccaggctgaagacgaggctgattattaactgcagctcatatacaggcagcagcactctaggtttcgcgggtaggaccaaggtcgtcgacccggttctacggtcacgacccgaaggtctccgcccccgtggtccc

SEQ ID NO: 151333 - DNA, 517 bp, Homo sapiens
  misc_feature: GYAE6OF02HP6O1.7.5.A05.1.454.CMB.1.raw
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaacgcccccaaagtcatcatttatgatgtctataactcggtccttcgagggtttccaatcgtcttctctggctcaagtctggcacgacgcctcctgaccntctcgtgggcctccgaggctaggaacgacgaggctagtattattactgcagctnatanacgagcagcagccacgtcgtaggtttcgcggacggaccagctcgaccgtcgtagtcacgccgagtcctcgtccccgtcgtacc

SEQ ID NO: 151334 - DNA, 544 bp, Homo sapiens
  misc_feature: GYAE6OF02IRWVM.7.5.A05.1.454.CMB.1.raw
  modified_base (429)..(429): a, c, t, g, unknown or other
  misc_feature (429)..(429): n is a, c, g, or t
  modified_base (480)..(480): a, c, t, g, unknown or other
  misc_feature (480)..(480): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctgtatcaacaataccagacaaacgcccccaaagtcatcattatgatgtctataatcgtccttcgtagggttcaatcgtcttctctgctcagtctggcgacacgtcctccgtacgaccactctcgtcggcctaccgaggctaggaacgacgacggtactagtatttagttactgacncgtactcgaattagtaccgtagcgagacgagccacttcgtagggtttccgnggacggactacgcgtaccggaccgtctacggcacgaccgacgtccgtccgtccccgtgtacccg

SEQ ID NO: 151335 - DNA, 553 bp, Homo sapiens
  misc_feature: GYAE6OF02GKTA5.7.5.A05.1.454.CMB.1.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaatacccaggcaaacgcccccaaagtcatcatttangatgtctataatcgcttcgagggtttccaatcgcttctctgctcagtctgcgacacggcctcctgaccatctcgtggctccgaggctgaagacgaggctagatttattactgacagtctactaatactaacgacggacagcacgctaacgttcggttacgggtttaccggacgggacggaaccgacgtcggtaccgtaccggtcgtacggtccgacgtaccgaacggtccgtcccgtccccggtcgtacccg

SEQ ID NO: 151336 - DNA, 588 bp, Homo sapiens
  misc_feature: GYAE6OF02IB6T0.7.5.A05.1.454.CMB.1.raw
  modified_base (234)..(234): a, c, t, g, unknown or other
  misc_feature (234)..(234): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (471)..(471): a, c, t, g, unknown or other
  misc_feature (471)..(471): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcatcggaaccaccaatgacgttncttggttaataaatatctctcctggtatacaacaatacccaggacaaacgacccccaaagtcatctatttatgatgtcttaataatccggtccttcgagggtttccaatcgtcttctcgtggtctcctaagtctggacacgccgcctccctgacctatctcgtggctcgnggtctaggagacgngctagtattattacgntcgacgtctacaattactacgtagacgtacgaccganccgtaccgttacgttacgggttttaccgggacggggtaccggaaccgtacgtacggtaccggtacccgtcgtacggtcacggtacccgaacggcccgtccgccccgtcggttacccg

SEQ ID NO: 151337 - DNA, 584 bp, Homo sapiens
  misc_feature: GYAE6OF02IJA3S.7.5.A05.1.454.CMB.1.raw
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcacatcctctgcactggaaccacactgacgttgcttaggttataatatctctcctgtactcaacaatacccaggacaaacgacccccaaagtcatctatttatgatgtctataatcggtccttgagggtttaccaatcgtcttctctcgtctccaagtctggcgtaccgacggccctccctcgaccatcctccgtggtcctcccgaggtctagaacgacggagctagtattagttactgactagctacataagtacgaagcacgcacgactactcgtacgggtttcgggacgggtaccgggacctaggaccgtaccggtacccgtaccgtacggaccgtacggacccgtacggtcccggttaccgcccccgttcggtacccg

SEQ ID NO: 151338 - DNA, 705 bp, Homo sapiens
  misc_feature: GYAE6OF02G1KQR.7.5.A05.1.454.CMB.1.raw
  modified_base (301)..(301): a, c, t, g, unknown or other
  misc_feature (301)..(301): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgacgttgctggttaataaatatctctctggtatcaacaataccaggacaaacgccccaaagtcatctatttangatgtactataattggccttacgtagggttaccaataccgtcttctactggtccttacgaagttcgtacggtacgacgaccgggtacccttaccccgtcgtaaaccctacttccgtaccggtttacggggtcccttacccgaacgggtaccgtaacggaaaacggtaccgggtaacgggtccgtaagttaactttaagtttaccgtacggtacgtaacgtaccgttacctaagttaactaaaccgaggtaacctagacccgaaggtaccctaaccgtttacggtaacgggttttccgggaacggggaaccggtaaccggaacggtccgtaacggtacccggttaccgttacggtaaccgacgggtacccaagggtccctccggacccccggttacggttacccg

SEQ ID NO: 151339 - DNA, 543 bp, Homo sapiens
  misc_feature: GYAE6OF02GZCBN.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatatctctcctggtatcaacaatacccaggcaaagcccccaaagtcatcatttatgatgtctataatcggccttcagggtttccaatcgcttctctggctcaagtctggcgacacggccctcctgaccatctctggctccaggctagaagacgaggctgattattactgacagctcatatacaggctagcagctactcgtaggtttccggagggacgggaccaacggctacggtacccggtccgttaacggtccgaccgacccgtaaggtcccgtccggtccccccgttacggtacccg

SEQ ID NO: 151340 - DNA, 594 bp, Homo sapiens
  misc_feature: GYAE6OF02HY8QQ.7.5.A05.1.454.CMB.1.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccacactgacgttgctggttaataaatntctctctggtatcaanaactaccaggacaaacgccccaaagtcatcattangatgtactataatcggccttcgtacgggttcaatcgtcttctctgctcaagtctacggacgacacgcctccgtcaccactctcgtggcctccgacggctacggaagtaccgacggctcgtaactttaacttacgtcgcgtacgctacattactaacgaggacacgcacgactacgtcgtacgggttttccgggacgggtacgggtaaccgtaacggccgttaccggtaccggttccgtaacggtaccgaccggacccgtaacgggtccgtacccggtcccccgtggttaacccg

SEQ ID NO: 151341 - DNA, 644 bp, Homo sapiens
  misc_feature: GYAE6OF02GI370.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctggtatcaacaactacccaggacaaacgcccccaaagtcatcatttatgatgtactataatcggccttcgtaggggtttaccaagtcgactttctctcggtctacctaacgtctcggaccgacaccggtccctcccgtacgaccctactccgttcgtcgggtcctcccgagggcctaggaacggacgagggtcctggtaactttaattacgtgccgtacggctactacttaataaccgagggcgaacgcgaacgtcctacgtacggttacgggttttccgggacgggtacgggaccgtaacggtcgtaccggtacccgtaccggttacggtacccgaccggacccgtaaccgggtcccgtacccggtacccccgtcgggttaccccg

SEQ ID NO: 151342 - DNA, 592 bp, Homo sapiens
  misc_feature: GYAE6OF02G79TI.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcgccttcagggtttccaatcgcttctctggctcaagtctggcgacacggccctccctcgaccatctcgtcgggcctccgaggtctagaacgacggaggctagtattattacgtcgacagtactacaattaactacgaggacacgacgagtacaccttacgtaacgggttttcgggaccgggtacgggaacccgaaaggtccgttaaccggtacccggttaccgttacggtaccgaccggacccgtaacggtcccgtacccggtccccccgtggttaccccg

SEQ ID NO: 151343 - DNA, 690 bp, Homo sapiens
  misc_feature: GYAE6OF02H4L37.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccccctgactcagcctgcctccgtgtctgggtctcctggacagtcgatcaccatctctgcactggaaccaccactgacgttgctggttaataatatctctctgtactcaacaactaccaggacaaacgaccccaaagtcaatctatttatgatgtactaatacgtccggtaccttacggtacggggtttaccaacgtcgtaccttccttcgtcgggtacctaccgtaacggttccgtacggaccgaccgtacccggtcccttccctacggtaccctacgtttacccgtcgtcgggtccctacccgacggtcgtaacggaacgtaccgggaggtaccgtagttactttaacttacgtacgtacgacgtcctactaacgtaactacgtaacggaccgacgaccacgtcctaacgtacggttacgggtttaccgggacgggtacggaccgtaacggtccgtaccggtaaccggttaccggtacggtaccgaccggtacccggtaacggtcccgtaccgtacccccggttacgtaccccg

SEQ ID NO: 151344 - DNA, 630 bp, Homo sapiens
  misc_feature: GYAE6OF02HRB6K.7.5.A05.1.454.CMB.1.raw
  modified_base (303)..(303): a, c, t, g, unknown or other
  misc_feature (303)..(303): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatacaacaactaccaggacaaacgccccaaagtcatcatttangatgtctatagtcgtcttcgtagggttcaagtcgtcttctctggctacaagtcgtcggcgaccgacccggtcccctcgacctactctcgtcgggtctccgacggtcgtacgaacggacggaggtacgttagtaacgtttaattacgtagacacgtcctacaactaacgtacgacggacgacgacgacgactaaccgttacggttacgggtttaccgggacgggtaacgggaaccgtaacggtaccgtacggtacccgttaccggtaccggtaccgtaccgacccggaacggtccgtacccgtcccccggttaccggtcctaacccgg

SEQ ID NO: 151345 - DNA, 659 bp, Homo sapiens
  misc_feature: GYAE6OF02JKIKS.7.5.A05.1.454.CMB.1.raw
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacaggtcgatcaccatcctcctgcacgtcggaaccaccactgacgttgcgtaggttaataatatctctcctggtatacaacactaccaggacaaacgaccccaaagtcaatctattatagatcgtactaataagtcgtccttcgtagggtttaccaatccgctttcncgtcggctaccgtagttcgnggaccaacgaccggtccctaccgtacgaacctacgtaccgtccggtcgggaccctacgacgggtaccgtaaggaaacggacggtacggtacctaagtactttaacgttacgtcgacgtagtcctacgtaattacgacgtacggactacggtacacggtctacgttacgttacggggttaccgacggggacgtaaccggtaacgtccgttaccggaccgttaccgttacggaccgacggttacccgaaccggtcgtaccccggtacccggtcgttacccg

SEQ ID NO: 151346 - DNA, 572 bp, Homo sapiens
  misc_feature: GYAE6OF02HKZX0.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagcccccaaagtcaatcatttatgatgtctataatcgccttcgagggtttccaatcgcttctctggtctcaagtctggcacgacgccctccctgaccatctctggcctccaggtctgaaggacgaggtactgtattattactgacagctacatatacacggcaagccgtagccacgttaccgtagggttttccgggacgggtacgggaccgaacggtcgtaccggaacccggttccgtacgggtaccgtaccgacccgaacgggtccctaccggtcccccgtccggttaccccg

SEQ ID NO: 151347 - DNA, 530 bp, Homo sapiens
  misc_feature: GYAE6OF02HF157.7.5.A05.1.454.CMB.1.raw
  modified_base (298)..(298): a, c, t, g, unknown or other
  misc_feature (298)..(298): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccaggcaaacgccccaaagtcatcatttangatgtctataatcggccttcgtagggtttcaatcgcttctctggctcaagtctgcgacacggcctccctgaccatctcgtggctccgaggctagaagacgagtctgattattactgcagctcatatacgagcagcagctactcgtaggtttcggacggacggaacgacggcgtacgtaccgtccgtacggtacgacgtacccgaaggtccgtcccgtccccgtcggtacccg

SEQ ID NO: 151348 - DNA, 567 bp, Homo sapiens
  misc_feature: GYAE6OF02GTFPY.7.5.A05.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (385)..(385): a, c, t, g, unknown or other
  misc_feature (385)..(385): n is a, c, g, or t
  modified_base (462)..(462): a, c, t, g, unknown or other
  misc_feature (462)..(462): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaacccnccactgacgttgcttggttataaatntctctcctggtatcaacaactacccagacaaacgcccccaaagtacactacatttatagtattgtctataatccggtcctttcgacggggtttccaatcgtacttctctggctctagtctggcgacgacgcctcccngtacccatctcgtcggcctccaggctaggaacgacgaggacctgtattattactgtcagctactatagtacaggtcngcagacctacttcggtaggtttcgggcggtacgggactacggtccgtacgtaccggtaccgtacggtaccgacgaccgaaggcctccggtccccgttcgtacccg

SEQ ID NO: 151349 - DNA, 608 bp, Homo sapiens
  misc_feature: GYAE6OF02GEO43.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgccctccgtgtctgggtctcctggacagtcgatcaccatctctgcactggaacccaccactgacgttgctggttaataaatatctctcctggtatcaacaatacccaggcaaagcccccaaagtcatcatttatgatgtctataatcggccttcagggtttccaatcgcttctctggctccaagtctggcgacacggcctccctgaccatcctacgtcgggccttccgagcgtagaaagacggaagggcctggtaactttaatttaaccgtgtccgtaagtcctactaattaactaccgtacggtcctaagccaagcctaacgttcggttaacgggtttttccggggacgggacgggtaacccaaggccgtacggtacccgttccgtaacgggtccacggtacccgaacggtccctaccggtaccccccgttggtaccccg

SEQ ID NO: 151350 - DNA, 539 bp, Homo sapiens
  misc_feature: GYAE6OF02HZE99.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgtactggaacccacactgacgttgctggttaataaatntctctcctggtatcaacaataccaggcaaacgcccccaaagtcatcatttatgatgtctataatcggccttcaggggtttccaatcgcttctctggctcaagtctggcgacacggccctccctgacctatctcgtgggcctccgaggctagaagacggagtctgtattattactgcagtctactatactacaggcagcagcacgttcgtaggtttcggacggacggaccagcgtcggaccgtacctaggtccacgcccgaaggtcctacccggccccgttcggtcctaccg

SEQ ID NO: 151351 - DNA, 706 bp, Homo sapiens
  misc_feature: GYAE6OF02H1AOK.7.5.A05.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (446)..(446): a, c, t, g, unknown or other
  misc_feature (446)..(446): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcagggcacgagggtcgtgggcccagtctgccctgactcagcctgccctcgtgtcgtgggtctccgnggacngtcgatcacatcctctcganacctcggaacccacctactggaaccgtttgcgttaggttaaataaacttactcctctcctaggtactacaacaactacccaggacaaaccggaccccaaagtacctatactaatttagtacgtatacgtacttaaatacgtcggttacttaggtacgggtttacctaatcgtctttcgcgtcggtaccttacgagtcctgggacctacgcccgtcctccgtacgaaccntttccgcgtacggcttccgacggtcacggtaaggacgtacgtacgtagtactttaacgtccgttacgacgtacgtactaccgtataaccgttacgaagtaccacgtacacggtaactacccggttaggttaaccgggtttcgggaacggaaccggtaccggtaaccgtaccggttaccggtaccggttaaccggtaacgttcccgaacggacccgtaacgggtccccgttaccggttccccccgtacgggtttaaccccg

SEQ ID NO: 151352 - DNA, 658 bp, Homo sapiens
  misc_feature: GYAE6OF02JLR9O.7.5.A05.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
tcagcgtgtctctacacgaccggtgctcgatttagatagatagacagggggggggtcgtcgaggaggcagcgctctcgggacgtcgtaccaccatggcctgggctctgctattcctcaccctccgtcactcagggcacagggtcgtgggcccagtctgaccctgacctcagtcctgacctccgtgtactgggtcctcctggaccnggtcgactcgaccatctcctgcactggaaccncactgacgttgctggttaanaaatntctctcctgtatcaacaacacctagcaaacgccccaaagtcatacattactaggtactgtctatacgtcgtcttacgtacgggttcaagtccgtcttctcgtggcctacacgtctcggtacacgtccgccctcctcgaaccgtgtacctccggtacggccttacccagggtcctaggaacggaacggtacgggctacggtaactttacttacgtcncgacgtcttacgactataaccgngtacgagtacgacgtacctattaccggtcggttttacccggggagggtaccggggtaacccctagggtacccggttacggacccgttaccggtacccgggttctaacggaaccccggacggttcccggacccggttaccccccggtacgggttaccc

SEQ ID NO: 151353 - DNA, 778 bp, Homo sapiens
  misc_feature: GYAE6OF02JVKQT.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctctgcactggaaccaccactcgacgttgcttggttaactaaattatcctaccttccgtaggtactacaaacaacttaaccaggtacaaacgaccccaagtccatacatttactgtatgtactactaacgtcggtccttacgtaggggtttaccaagtccgtactttcgtcgtcgtcctacgtaacgttcgtcggaccgtaccgtaccggtcccttacccgtacggtaaccctacgtttcccgttacgtacgggtccccttaccggtaacgggtaccgttaacgggaaacggtaaccgggtaacggttacgttacggttaaacgtttaaccgttaccggtttaacggccgtaaaccgtcgttacctaaacttaacgttaccgacggtacgaacgactaacgtaccgttaaccgtacggtttaaccgggtttccggggaacgggttaccgggtaaaccgtaccggggtacctaaaccgggttcccgttaacccgggttaacggtacccggaacccgggttacccggaaccgggttacccttccccgggtaacccccggtttccggttaccccg

SEQ ID NO: 151354 - DNA, 524 bp, Homo sapiens
  misc_feature: GYAE6OF02FZTAP.7.5.A05.1.454.CMB.1.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaataccaggcaaagcccccaaagtcatcatttangatgtctataatcggcttcagggtttccaatcgcttctctggctcaagtctggcacacggcctcctgaccatctctgggctccaggctgaagacgaggctggattagttactgcagtctcaatacttacaggtaccagcagcaactcgtaggtttcggcggacgggaccgagtctcgtaccgtccgtaggtccgacggccaacggtctccgtcccccgtcgtcccg

SEQ ID NO: 151355 - DNA, 518 bp, Homo sapiens
  misc_feature: GYAE6OF02HPAYQ.7.5.A05.1.454.CMB.1.raw
  modified_base (367)..(367): a, c, t, g, unknown or other
  misc_feature (367)..(367): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctgtatcaacaataccaggcaaagcccccaaagtcatcatttatgatgtctataatcggtccttcgagggtttccaatcgtcttctctgctcaagtctgcgacacggcctcccgngaccatctcgtggctccgagctagaagacgaggctagtattaattacgtgacacgctactataacgtacaaggcagcagcactctaggtttcgcgggagacacggcgtcgaccgtcgtacgcacgaccgacgtccgcgtccctcggtaccg

SEQ ID NO: 151356 - DNA, 539 bp, Homo sapiens
  misc_feature: GYAE6OF02GG9OV.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaactaccaggacaaacgcccccaaagtcatcatttatgatgtctataatcggccttcgtacggggtttccaatcgtcttctctgctcaagtctggcgacacggccctcctcgaccatctcgtcggcctccgaggctagaacgacggaggctagtaattacttactgcagctacatatacaggcagcagcactcgtaggtttcgggcggtacggaccgaacgcgtacggaccgtccgtacggtcacgcccgaacggcctccgccccgtcggtacc

SEQ ID NO: 151357 - DNA, 647 bp, Homo sapiens
  misc_feature: GYAE6OF02IK0S2.7.5.A05.1.454.CMB.1.raw
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttaataaatntctctctgtatcaacaactaccaggacaaacgcccccaaagtcatctaatttangtatgtctaataacgtcggtccttcgtagggtttaccaagtcgtcttctctggcctacaagtcgtcggcgaccacggccctcctcgacctatcctcgtcggcctccgacggctaggaacggacgacggtcttagtatttacttacgtgacgtacgtcttactaattaactaacgacggtaccagactaacgccttaaccgtacggtttacggggttttcccgggacggggtaacgggaaccggtaacggtccggttaaccggtacccggttacccgtaacgggtaccgtaacggtaccccggtaacgggtcccgtcccgggtaccccccgttccggtaccccg

SEQ ID NO: 151358 - DNA, 614 bp, Homo sapiens
  misc_feature: GYAE6OF02HL24R.7.5.A05.1.454.CMB.1.raw
  modified_base (464)..(464): a, c, t, g, unknown or other
  misc_feature (464)..(464): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgaatcagcctgcctcgtgtctgggtctcctggacagtcgatcaccatcctcctgcactcggaaccaccactgacgttgctggttaataatatctctcctggtatacaacaataccagacaaacgaccccaaagtcatctatttatgattgtactataactccggtcttcgtagggtttaccaatcgtcttctctcggctaccagtctggacgacgtaccggtccctccctacgacctactccgtcgtcgggtcctaccgaggtctaggaacgacggacggtctagtatttacttacgtcgacgtanctactaactacgtaacgaggtcaacgcaacgactacgtacggttacgggtttacgggacgggtacggaaccgtaaggccgtacggtacccgttaccgtacgggaccaccggaccggaaccggtccgtacccggtccccgttacggtaccc

SEQ ID NO: 151359 - DNA, 750 bp, Homo sapiens
  misc_feature: GYAE6OF02ICSU4.7.5.A05.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (553)..(553): a, c, t, g, unknown or other
  misc_feature (553)..(553): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacngtcgatcaccatctcctgcactggaacccnccactgacgttgcttggttaataaatctctctcctggtatacaacaataccaggacaaacgcccccaaagtccaatctaatttatgtatcgtactaatacgttccgtcctttacgtacggggttttaccaattcgtacttctcgtcggtcctaccgtaagttccgtcggaccgtaaccgtacccgggtacccttacccctaccggtaaccctaacgttcccgttccgttacggggtaccctcccgtaacgggtcctaacgggtaaaccggaccgggtacggtacgttacggtaactttaacgtttaacgtcggtacgtaccgtcccgttanaacgttaacgtaccggtaacggacgtaacgtacgtacgaccgtaaccggttaccggtttaacgggtttcccggggaacgggtaccggtaaaccggacggttccggtaaccggttcccgggttaaccgttaccgggtacgtaccggaacccggtaccgggtaccccgttcccggtaccccccgttccggttaccccgg

SEQ ID NO: 151360 - DNA, 537 bp, Homo sapiens
  misc_feature: GYAE6OF02GNHJI.7.5.A05.1.454.CMB.1.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaaacaatacccaggcaaagcccccaaagtcatcatttangatgtctataatcggcttcaggggtttccaatcgcttctctggctcaagtctggcgatacggcctccctgaccacttctctgggctccgaggctgaagacggaggtctagtattattactgccagctcatactacgaggcagcagcactcgtaggtttcggcggtacgggaccaaggtctacggaccggttccgtaggtccgacgtacccgaaggtcctcgtcccccttgggtaccc

SEQ ID NO: 151361 - DNA, 710 bp, Homo sapiens
  misc_feature: GYAE6OF02JYGAQ.7.5.A05.1.454.CMB.1.raw
  modified_base (548)..(548): a, c, t, g, unknown or other
  misc_feature (548)..(548): n is a, c, g, or t
tcagcgtgtctctacacgaccggtgctcgatttagatagatagacaggggggggtcgtcgaggaggcgagcgctctcgggacgtctccaccatgcctggctctgctattcctcacctcctcactcaggcacagggtcgtggcccagtctgccctgactcacgcctgcctccgtgtctgggtcctcctggacagtcgatcaccatcctcctgcactggaacccaccactcgacgttgccttggttaataaatattctccttacctggtactacaactaaactaccccaaggaccaaaaccgacccccctaaaacggtccaataccctatttaacgtgtaatcgttaccttaataacgttcggtaccctttgtacggggttttaccaacgttcgtcttctctggtcctacctaagtcgtacggcgaactccggtaccctcccgtcgacccgtacttcgtccgtacgggtcctacccgtacgggtcgtacggaaacggacggtacgggtacgtacgtagttaacttaacgtttcgctaacgctacacttanacgtacggactagaccgacgtaccacgttccggtacggtttacgggaccggggtaccgggtaccggaacggtaccggtaccggtacccggttaccgtaacgggtaccgtaccggaaccccgacgggtacccgtcccgggttaccccccgtcggtaacccccg

SEQ ID NO: 151362 - DNA, 576 bp, Homo sapiens
  misc_feature: GYAE6OF02HIJFS.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaacgccccaaagtcatctattatgatgtctataatcggtaccttcgtagggtttccaatcgcttctctggctccaagtctggccgacgaccggccctccccgtcgaacccgtactccgttccgtcgggccttacccgacggtccgtaggaaacgacggacgggcttagtaatttaacttacgtgactacgctcgaattacacgaggcagcagctacgtcgtaggtttcgacggacggacgacgtcgtcgtaccgtcgtacggtacacggaccgacggcctacccggccccgtcggtaccc

SEQ ID NO: 151363 - DNA, 754 bp, Homo sapiens
  misc_feature: GYAE6OF02H2IG2.7.5.A05.1.454.CMB.1.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacngtcgatcaccatctctgcactggaaccacactgacgttgactggttaanaaatatctctcctaggtatcaaacaaactacccgaggacaaaacgacccccaaagtccaatacaattttaacgtggacttgtacctaattaaacgttccgggtacccttttaccggtaacggggttttacccgtaaaacgttcggtaccttttcgttacccgttcggtaacccgtttaccgtaaaaccggttccgtttagggtaccggaacccgtaacccgggtccccttacccccgttaccggtaacccgtaactttcccgttacgttccggggtaccctacccgtacgggccgttaacggaaacggtaacggaaccgggttacgttacgtaacggtttaacttaacgttagtacctaaggtccttactaagttactaaaccggtaggaccgaacgcgagtacctacgtaaccgttacgggtttacggaccgggtacggaccgaagcgtacggacccggttcaacggtacgacgacccgtaacgaccggcccgtacccccgtggtacccg

SEQ ID NO: 151364 - DNA, 591 bp, Homo sapiens
  misc_feature: GYAE6OF02INJUK.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcacccctcctcactcagggcacagggtcgtgggcccagtctgccctgactcagcctgcctccgtgtctgggtctcctggacagtcgatcaccatctctgcactggaaccaccactgacgttgctggttataaatatctctctgtatcaacaactaccaggccaaacgacccccaaagtcatactatttatgtatgtactaataactcggtccttacgtacgggtttccaatccgtcttctcgttcgctaccaacgtcgtcggcgtaaccgaccgtccctccctcgacccacttcctcgtcgggtcctaccgacggcgtaggaacgacggacggtcttagtatttacttacgtcgactacgtctactaatactacgagcgagcagtccacgtcgtacgggttacggcggtacggaccacggtcgtacgaccgttacgtacgtaccgacgacccgaggtccgtcccgcccgtaccggtcc

SEQ ID NO: 151365 - DNA, 790 bp, Homo sapiens
  misc_feature: GYAE6OF02GQF90.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatatctctcctgtatacaacaactaccaggacaaacgcccccaaagtcatactatttatgatgtactaataacgtccggtccttcgtacgggtttaccaatcgtcttcctctcggtcctacctaacgttcgtaggaccgaaccgtacccggggtaccccttccccgtacggaaccctactttacccgttccggttacggggtccccgtttacccggtaaacgggtacccgttaacgggaaaacgggtaccgggtaacggggtaccgtttaacgggtttaacttttaaacgttttaacccgtacggtaccgtaacggttccctacgtaaacgttaacgttaaaccggacggtacgtaacgtaccgaacggtaccctaaaccgtttccggttaaacgggggtttttccggggaaccggggtaaccggaccgtaaaccgggtcccggttaccggtaaccccggttaacccgttacgggtacccgtaacccggtacccggtaacccggtaccccggtaccccggtacccccgttaccggttaccccg

SEQ ID NO: 151366 - DNA, 648 bp, Homo sapiens
  misc_feature: GYAE6OF02HDC51.7.5.A05.1.454.CMB.1.raw
  modified_base (194)..(194): a, c, t, g, unknown or other
  misc_feature (194)..(194): n is a, c, g, or t
  modified_base (311)..(311): a, c, t, g, unknown or other
  misc_feature (311)..(311): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacngtcgatcaccatcctcctgcacgtggaacccaccacgtgacgttgcttaggttaataaatctctctcctggtactacaacaactaccaggacaaacgcccccaaagtcatctattangatgtctatacgtcgtccttcgtagggttccaatcgcttctcgtgtctacagtcgtggcgacgccggtccctcccgtacgacctactccgtcgtcgggtcctccgacggtcgtaggaacgacggaggtctagtactttaagttaccgtgtacgacgtctactaacttacgtaccgacggtacgacgtaccgtacgtacctaccgttacggttaacgggttttacccgggacgggtaccgggaccgtaacgggtccgtaccggtaccccggttacgtaccggtaccgaccggtaccccggacggtccccgtacccggtcccccgtaccggttaccccg

SEQ ID NO: 151367 - DNA, 828 bp, Homo sapiens
  misc_feature: GYAE6OF02F4J2C.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctcgtcgggacgtctccaccatggcctgggctctgctattcctcaccctcctcactcagggcacagggtcgtgggcccagtctgccctgactcagcctgcctccgtgtctgggtctctggacagtcgatcaccatctcctgcactggaaccaccactgacgttgcttggttataaatnctctctgtatcaacaataccaggacaaacgccccaaagtccatctaatttatgattgtactaataatccggtacctttacggtaacggggttttaccaacgttccgtaccgttttccgtcgttcgggtccttaccgtaacggttcgtcgggtacggtaacctaacccggggtcccttccccgtaacggtaccctaacgttccgttaccggtcggggtccccttacccggtaagggtcccgttagaaaacgggtaccgggtaaagggtccgtttaggtaacttttaaacggtttacccgttaggtaccgtaacggttacccttacgtaaactttaacgtaaccggttaacgggacctaaacgggccgttaaacccggacccgttaaccgtttacccggttttaacggggggtttttaccgggtacccgggggaaacgggggttaccccgtaaaacggggttcccgttaacgggtaacccccgggttacccggttaaacgggttcccggtaaaccgggtaaccccgtaaaccgggtcccgttttccccccgggtaacccccggttcccgggtttaaccccg

SEQ ID NO: 151368 - DNA, 594 bp, Homo sapiens
  misc_feature: GYAE6OF02GW97J.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgcacgtcggaaccacactgacgttgcttaggttaataatntctctcctgtatcaacaataccaggacaaacgaccccaaagtcatctatttactagtatgtactaataagtcggtaccttcgtacgggtttaccaactcgtcttctcgtcgctcctaagtcgtggacgaacgccgtcctcccgtacgacctactcttcgcggtctaccgagggtcctaggaacggtacgaggctagtaacttacttacgtcgactagtctacattagaacgtaggcagcacgctaacgtcgttaagggttccggagggtacggactacggtccgtacggtaccgtccgttacggacctaccggtaccgaggccctaccggtccccgtagtacccg

SEQ ID NO: 151369 - DNA, 593 bp, Homo sapiens
  misc_feature: GYAE6OF02GEF9Q.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctggtatcaacaataccaggacaaacgacccccaaagtcatctattatgatgtctataatcggtcttcgtagggttccaatcgtcttctcgtggactacctaagtctggcgaccacggtccctccctcgacctactctcgtcgggctccgaggctagaaaggacgaggctgtaattattactgctagcttacaatactacgacggacagcagcctaacgtcgttacgggtttccgggacgggtaccgggaaccgaacggtccgtaccggtacccggtaccgttacggtacccgaccgtacccggaacggtcccgtacccggtcccccgtcggttaaccccg

SEQ ID NO: 151370 - DNA, 724 bp, Homo sapiens
  misc_feature: GYAE6OF02IEJI1.7.5.A05.1.454.CMB.1.raw
  modified_base (254)..(254): a, c, t, g, unknown or other
  misc_feature (254)..(254): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgaggggggggtctcaggaggcagcgctctcgggacgtctccaccatggcctgggctctgctattcctcaccctcctcactcgagggcacgagggtcgtgggcccagtctgccctgactcgagcctgcctccgtgtctgggtctcctggacagtcgatcaccatcgtcctgcactcggacccaccagtgaccgttgctaggttaataatntcctctccttgactacaacaactacccaggaccaaacgtacccccaaagtcacgtactattagntagttctataattacgtccgtacgttcggtacggtttacctacgttcgttccttacgtcgtccggtacttacgtacgttcgtccggtaaccgaccgttacccgcccgttacccgacgtacccgtactttaccggtcggtccggcgtaaccgacggtcgtaacggaaggaaccggtcgtacttaggttaacttacggttacgtaccgtactaaccggtacttacgaagttaactacgacggtaacacgacgtaaccggtacttccgggttaaccggtttacggggtttaaccgggacggtaccgaacggtaccggacggtttaaccggaaccggttaccggttaccggtaacgtacccggtaacccgtccgggtcccgttacccgttacccccggtaggtttccccg

SEQ ID NO: 151371 - DNA, 541 bp, Homo sapiens
  misc_feature: GYAE6OF02FYUPU.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatntctctcctggtatcaacaactaccaggacaaacgacccccaaagtcatctatttatgatgtctataactcgtccttctacgggttccagtcgcttctctggctcagtctgcgacacgcctcctcgacctactctctcggcctcagcgtgaagacgagcgtgtattattacgtgacacgtctctatatacgagcagcacgcactcgtacggtttcggcggtacggaccgacgcgtacgtaccgtcgtacggtacgacggacccgacggtcctaccggtccccgtcggtacccg

SEQ ID NO: 151372 - DNA, 619 bp, Homo sapiens
  misc_feature: GYAE6OF02IOHLB.7.5.A05.1.454.CMB.1.raw
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgaccgttgcttggttaataaatatctctcctggtatcaacaataccaggacaaacgcccccaaagtcatctaatttatagatgtactataatcggtccttagtacgggtttaccaagtcgtcttctctgtcctcaagtctggacgacncggcctcccgnacctatctcgtcggctccgagtctagaacgacggacgtcgtagtaagttaacttaacgtcgactacgtcttacgaacttactacgacggacaacgaacctaaccaccgttacgttacgggttttccgggaacgggtaccgggaccgaacggtccgtaccggtacccgttaccggtacggtaccgaccggtacccgaagggcccgtacccggtccccgtccggtactacccg

SEQ ID NO: 151373 - DNA, 644 bp, Homo sapiens
  misc_feature: GYAE6OF02JEORB.7.5.A05.1.454.CMB.1.raw
  modified_base (304)..(304): a, c, t, g, unknown or other
  misc_feature (304)..(304): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaaccaccactgacgttgctggttaataaatatctctcctggtatcaacaataccaggacaaacgacccccaaagtcatacatttangatgtctataatcgccttcgagggtttccatcgacttctctggctcaacgtctggcgacgaccggtcctcccgtcgacctactccgtcgtacgggcctaccgacggtcgttaggaacgtacgggacgtacgtcggtaatttacgttactcggtacacggtcttacgacttaactaccgaggtaccgaagtaccgacgtcctacggttaccgttacgggttttccgggacgggttacgggaccgtaacggtccgtaccggtaacccgttaccggtaacggtacccaccgggtaacccgaaccgggtaccgtccccgggtcccccgttacggttaaccccgg

SEQ ID NO: 151374 - DNA, 524 bp, Homo sapiens
  misc_feature: GYAE6OF02F24B9.7.5.A05.1.454.CMB.1.raw
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaacgcccccaaagtcatcatttatgatgtctataatcggcttnagggtttccaatcgcttctctgctccaagtctggcgacacgcctccctgaccatctcgtggctccaggctgaagacgaggctgattattacgngcagctanataatacgagcagcagcactctaggttcggcggaggaaccaggtctacggacccgtccgtaggtcgacgacccgaacggtccgtcccgtcccccgtgtacccg

SEQ ID NO: 151375 - DNA, 541 bp, Homo sapiens
  misc_feature: GYAE6OF02JD8Q2.7.5.A05.1.454.CMB.1.raw
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggacaaacgcccccaaagtccatctatttatgattgtactataacgtcggccttcgtagggtttaccaagtcgtcttctcgtcggctccgaagtctggacgacgaccggccctcccgtacgacctactctcgtcggctccgaggctgaacgacgaggctgtattacttacgtcgacncgctacatactacgngacngacngctactcgtagttcgggcggaggaccagctcgaccgtcgacgtcgacgccgagcctcgccccgtgtacc

SEQ ID NO: 151376 - DNA, 639 bp, Homo sapiens
  misc_feature: GYAE6OF02FTB2Y.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaataccagcaaacgcccccaaagtcatctatttatgtatgtctataatccggtccttcgtacggggtttccaagtcgtacttctcgtggctacctaagtctgggcgacgaccggtccctcccgtacgacctactcctcgtcgggcctccgaggtctaggaacgacggacggtcctagaactttagttacgtcgtcagtctacgatagtaaccgaggtacaagaccagacctactacggttacgggttttaccgggacggggtacgggtaccgaacggtccggttaccggtaacccggttcccggttaacgggtcccgaaccggaccccggtaacggtacccgtacccggtaccccccgttaccgggttacccccg

SEQ ID NO: 151377 - DNA, 562 bp, Homo sapiens
  misc_feature: GYAE6OF02FLTZY.7.5.A05.1.454.CMB.1.raw
  modified_base (301)..(302): a, c, t, g, unknown or other
  misc_feature (301)..(302): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaagccccccaaagtcatcatttannatgtctataatcggccttcgtagggtttccaatcgctttctctggctccaagtctggcgacacggtcctccctcgaccatcctcgtcggctccgagctagaacgacgaggctgaattattactgcacgctcatatacaggacagcagacctacgtcgtacgggttttcggacgggtacggaaccgaggtccgtgacccggtaccgttacggtaccgaacgtacccgaacggacccgtccggcccccgttaccggtacccg

SEQ ID NO: 151378 - DNA, 610 bp, Homo sapiens
  misc_feature: GYAE6OF02H6SDV.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccttgacagtcatcaccatctcctgcactcggaaccacactgacgttgctggttaataaatntctctcctggtactcaacaataccaggacaaacgccccaaagtcatctatttatgatgtactataactcggtcctttcgtacgggtttaccaatcgtcttctctcggctacctaagtcgtggccgaacgccggtaccctcccgtacgaccctatcctcgtcgggccctaccgagcgtagaacgacggacgtctagtatttaacttactcgacagtctacatacgtaacgaggcagacacgtacctacgtacgttaacgggtttcgggaccgggtacgggaccaacggtccgtaacggtcccgttaccgtaccggtcgaccgtacccgaaggtacccgtcccggtcccccgtacggttacccg

SEQ ID NO: 151379 - DNA, 576 bp, Homo sapiens
  misc_feature: GYAE6OF02INTCX.7.5.A05.1.454.CMB.1.raw
  modified_base (460)..(460): a, c, t, g, unknown or other
  misc_feature (460)..(460): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctctgcactggaaccaccactgacgttgctggttaataaatatctctcctggtatcaacaactacccaggcaagacccccaaagtcatcatttatgatgtctaataatcggccttcgtagggtttccaagtcgtcttctctggcctccaagtctggcgacgacggccctccctcgacctactcctcgtcgggcctccgacggctagaagacgaggctagtattattactagcgatctctatagtacgacggcancagacctacgtcgtacgggttttcggacggacgggtaccgaggtccgtcggtacccggttccgtacggtaccgacggacccgaacggcccgtaccgtccccccgtacggtaccccg

SEQ ID NO: 151380 - DNA, 551 bp, Homo sapiens
  misc_feature: GYAE6OF02JJ37M.7.5.A05.1.454.CMB.1.raw
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttataaatatctctctggtatcaacaataccaggcaaacgacccccaaagtcatcattatgatgtctataatcggccttcgtagggttcatcgacttctctggctacagtctggacgacacgtcctccctacgaccatctcgtcgggtctccgaggctagaagacgaggcgtacgtattacttactgacagtctcatactacgtacgactagacacgactactcgtacggttttccggacgggtacggacaacggcgtacgtaccgtacgtacggacacgaccgtacgccgtaccgtccccgtcgtacccg

SEQ ID NO: 151381 - DNA, 566 bp, Homo sapiens
  misc_feature: GYAE6OF02FNQ6F.7.5.A05.1.454.CMB.1.raw
  modified_base (303)..(303): a, c, t, g, unknown or other
  misc_feature (303)..(303): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctggtatcaacaatacccaggacaaacgcccccaaagtcatcatttangatgtctataatcggccttcgagggtttccaatcgcttctctggctcaagtctggcgacacggcctccctgacctatcctcgtcgggcctccgaggctaggaacgacggacggcgtgtatttaacttactgacacgctacatatacaggcagcagcactcgtagggtttcgggcgggacgggaccgaacggtctacggacccggtaccgtaacggtaccgacggtacccgaacggtccgtcccggtcccccgttcggtacccg

SEQ ID NO: 151382 - DNA, 543 bp, Homo sapiens
  misc_feature: GYAE6OF02GV8K6.7.5.A05.1.454.CMB.1.raw
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatatctctcctgtatcaacaataccaggacaaagcccccaaagtcatcatttatgatgtctaataactcggtccttacgacggggttttccaatcgtcttctctcggctccaagtctggcgacacggccctccctgaccatctcgtcggctccaggctagaagacgagctagtattattactgacngctacatatacagcagcancactcgtacgggtttcggacgggtaggacaacgtcgtacgtaccggtacctaggtcgacgaccgaacggcctaccggcccccgtaggtacccg

SEQ ID NO: 151383 - DNA, 731 bp, Homo sapiens
  misc_feature: GYAE6OF02H7RQE.7.5.A05.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
tcagcgtgtctctacacgaccggtgctcgatttagatagatagacaggggggggggtctcaggaggcagcgctctcgggacgtctccaccatggcctgggctctgctattcctccaccctcctcactcagggcacagggtcgtgggcccagtctgccctgactcagcctgcctcgtgtctgggtctcctggacngtcgatcaccatctcctgcactcggaacccaccattgacgttgcttggttaataaatntctctcctggtactcaacaatacccaggacaaacgcccccgaaaagtcaataccgtattttatgtaacttgttacttaataacttccgggtccttttacgtaacggggttttacccaaagttccgtccgtttccgtcttcgggaccttacccaagttaccttgggaccgaaccgaacggtcccctcccctaggaccctattaccgttccgtcgggtaccttccgaacggtccgtaacggtaaaggacggtaacgggtacgttaggttaacgtttaacttaacgttcgcgtacgtcgttacaacttaagttaaccgtaacgggacacgacgtacgaccttacgtaccgtttacggggttttaccggggcggtaacggggtaaccgtaaaggtccgtacggtaacccggttacccgttaacgggtaccgtaccgggaacccgtaaccgggaccgtcccggtccccccgtacgggttacccg

SEQ ID NO: 151384 - DNA, 591 bp, Homo sapiens
  misc_feature: GYAE6OF02JC4CT.7.5.A05.1.454.CMB.1.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatntctctcctggtatcaacaatacccagcaaagcccccaaagtcatcatttacngatgtctataactcggccttcgagggtttccaatcgcttctctggctcaagtctggcgacacgcctccngaccatctcgtcggctccgaggtcctagaacgaaccggacggtctacgtaatttacttaacgtgtacacgtctactaacttactaaccgacggtcgaacgtcgaacgctaaccgtacgttagggttttccgggacgggtacgggaccgaacgcggttacgaccggttccgtacggtccgtaacggtcccgaaccggtcgtacccggtccccgtccggtacccg

SEQ ID NO: 151385 - DNA, 730 bp, Homo sapiens
  misc_feature: GYAE6OF02GBTOQ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctgtatcaacaactaccaggacaaacgcccccaaagtcatctatttatagattgttactaataaacgttccggtccctttacgtacggggttttaccaacgttccgtcctttacctcgttcgggtaccttaccgtaaacgttccgtcgggtaccggaacccgtaacccgggtccccttccccgtaccggtaaccctacttacccgttacgttcggggtacccttccgacggtaccggttaggaaacggaccggtaacgggtccgtacgttaacgtttaacgtttaaccgtggacctacggtacctactaaacttaactaacgtacgggtaccgacgtacgtaaccgtactaaccgttacggttacgggtttcgggaaccggggtacgggaaccaacggtcgtaccggtacccgttaccgtacggtccgaaccggtacccgaacggtcccgtacccgtccccgtaccggttacccg

SEQ ID NO: 151386 - DNA, 545 bp, Homo sapiens
  misc_feature: GYAE6OF02JHNFZ.7.5.A05.1.454.CMB.1.raw
  modified_base (357)..(357): a, c, t, g, unknown or other
  misc_feature (357)..(357): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggcaaacgcccccaaagtcatcatttatgatgtctataatcggtccttcgagggttccaatcgtcttctctgctcaagtctgcgacncggcctcctgacctatctctgggcctccgagctagaagacgaggctgtaattattactgcagtctacatactaacaggtcagccagctactcgtacggtttcgggacggacgggtaccaagtcctacggacccgtccgtaacggtccacggtacccgaacggtcctacccggtccccgtcggtacccg

SEQ ID NO: 151387 - DNA, 716 bp, Homo sapiens
  misc_feature: GYAE6OF02F7P9N.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatatctctctggtatacaacaactaccaggacaaacgacccccaaagtcatctatttatgtatgtactaataacgtcgtaccttacgtacgggtttaccaagttccgtcttccttcgtcggtcctaccgaacgttcgtacggaccgtaccgacccggtcccttccctacgaccctactttccgtccgtcgggtccctccgagggtctaggaacggacggacggtactagtactttagttactgacgtacgtacgtactaacgtaacgttaacggaacggtacgaacgaccgacgtaccgtaaccgttaccggttaacggggttttcccggggaacggggaaccgggtaaaccgtaaccgggttaccgtaccgggttaaccccggttacccggttaacggtcccggaaaccggtaccccggtaaccgggtccccggttaccccggtacccccccggttaccgggttacccccg

SEQ ID NO: 151388 - DNA, 573 bp, Homo sapiens
  misc_feature: GYAE6OF02IB355.7.5.A05.1.454.CMB.1.raw
  modified_base (251)..(251): a, c, t, g, unknown or other
  misc_feature (251)..(251): n is a, c, g, or t
  modified_base (402)..(402): a, c, t, g, unknown or other
  misc_feature (402)..(402): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatctcctgcactggaacccaccactgacgttgcttggttaataaatntccttctccttggtatcaacaatacccaggacaaacgcccccaaagtcatcatttatgatgtctataatcggctttcgtagggtttaccaatcgcttctctggtctctagtctggcgacgcgccctcctcgaccatctcgtggctcgagcngaagcgagctgattattactgcagtcactatatacgaggcagacacgcctacgttcgtacgggttttcgggcgggtacgggtaacgtaacggccgttacggacccggttaccgtacggtaccgaccggtacccgaaccggtcccggtacccggtcccccgttcggtacccg

SEQ ID NO: 151389 - DNA, 666 bp, Homo sapiens
  misc_feature: GYAE6OF02II6CL.7.5.A05.1.454.CMB.1.raw
  modified_base (223)..(223): a, c, t, g, unknown or other
  misc_feature (223)..(223): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcacgtgaaccncactgacgttgctggttataaatatctctcctgtatcaacaataccaggcaaacgaccccaaagtccatacctaatttatgtattgtacttaataagtcggtccttacgacgggttttaccaagttcggtacttctcgttcggcttaccgaacgttcgtacggtcgaacgaccggtcccttcccgtacgaccctacgttcctacgtcgggtacctcccggaggtcctaggaacggacgacggctagtaacgttacttaacgtgacagcttagaacttatacgtacggctaacgcgtaacgccttaaccgtcgtttacggggtttccggacgggtacggggtaaccctaacggtccgttacgggtacccggttaccggttaaccggtaccgtaccggacccgtaaacgggtcccgtacccggtccccccgggtagttacccccg

SEQ ID NO: 151390 - DNA, 530 bp, Homo sapiens
  misc_feature: GYAE6OF02F9I03.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccaggcaaagcccccaaagtcatctattatgatgtctataatcggccttcagggttcaatcgcttctctgctacaacgtcgtgcgacacggcctccctgaccctactctcgtcggctccgagctagaagacgagtctagtattattactgcagtctcatatacagcagcagacactcgtacggtttcggacggacggaccacgtcgtacgtaccgtcgtaggtaccgacgacccgaaggtccgtccgtcccccgtggtacccg

SEQ ID NO: 151391 - DNA, 581 bp, Homo sapiens
  misc_feature: GYAE6OF02GK6J7.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaataccagcaaacgccccaaagtcatcattatgatgtctataatcgcttcagggttccaatcgcttctctggctcaagtctggcgacacgcctccctacgaccactctcgtcggctaccaggctagaacgacgacgctcgtattagttactgacacgtctactattacaacgacggacagccacggctaaccgttcgtacgggttttccgggacgggtacgggaaccgtaaggtccgttacggacccggttaccgttacgggttaccgaaccggcccgtaaaccggtccggtacccggtcccccgtaccggttacccg

SEQ ID NO: 151392 - DNA, 758 bp, Homo sapiens
  misc_feature: GYAE6OF02HBQ52.7.5.A05.1.454.CMB.1.raw
  modified_base (211)..(211): a, c, t, g, unknown or other
  misc_feature (211)..(211): n is a, c, g, or t
  modified_base (321)..(321): a, c, t, g, unknown or other
  misc_feature (321)..(321): n is a, c, g, or t
tcagcgtgtctctacacgaccggtgctcgatttagatagatagacagggggggggtctcgaggaggcagccgctctcgggacgtctccaccatggcctgggctctgctattcctcaccctcctcactcgagggcacgagggtcgtgggcccagtctcggccctgacctcgagcctgcctccgtgtctgggtctcctggacagtcgatcacntctctgcacgtcggaaccacactgtacgttgcttagttaataaatctctctccgtgtactacaacaactaccgaggacaaaccgaccccctaaagtcaactctaatttangtactgtactaataacgtccggtaccttacggttacgggtttacctaagttccgtctttcgtcgtcggtcctaccgtaacgttcgtacggccgaaccgtaccgtcccgttccgtacgtaccctacgtccgttcgtccggggtccctaccggtacggtccgttaagggaacggaacgggtaggtaccgtagttaacgtttaacgttaacgtcgtaaccgtaacgttccgttaactaaagttaaccgttacggacggtaccgtaacgacgtaaccgtaccgtaaccgttacggttaaccggggttacgggaaccggggtaacggaacccgtaacgggtaccggttaccggaacccggttaccggttaaccggtaaccgtacccgggtaacccgtaaccgggtccccttaaccccggtccccgttacgggtttaaccccg

SEQ ID NO: 151393 - DNA, 560 bp, Homo sapiens
  misc_feature: GYAE6OF02GH65C.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaatacccaggacaaacgcccccaaagtccatctatttatgtatgtctaataatccggtccttcgtacggggtttaccaagtccgtctttctcgtcggcctaccaagttctggcgacaccgggccctccctagacccattcctcgtcgggcctccgaggctaggaacgacggaggctagtatttacttactgactacgctacatatacgagcagcagctactcgtaggtttcggcgggtacggacgacgcgtcgaccgtaccgtagtccgacgccgaggcctccgtcccgtcggtacc

SEQ ID NO: 151394 - DNA, 689 bp, Homo sapiens
  misc_feature: GYAE6OF02H3ELQ.7.5.A05.1.454.CMB.1.raw
  modified_base (258)..(258): a, c, t, g, unknown or other
  misc_feature (258)..(258): n is a, c, g, or t
  modified_base (428)..(428): a, c, t, g, unknown or other
  misc_feature (428)..(428): n is a, c, g, or t
tcagcgtgtctctacacgaccggtgctcgatttagatagatagacagggggggggtctcaggaggcagcgctctcgggacgtctccacatggcctgggctctgctattcctcaccctcctcactcagggcacgagggtcgtgggcccagtctcgccctgactcgacgcctgccctccggtgtctgggtctccgtggacagtcgatcacatctcctgacactcggaacccacactgacgttgcttaggttaataaactntcctctccgtaggtactacaacaactaccgaggacaaaccgccccaatcatctaattatgatcgtactaatagccgtcttacggtacggtttaccagttcgtcttcgtcgtcgtccgtaactaacggtccgtggaccgtaaccgtcccggtaccttcccgtcggtaaccngttccgtcgtacggtcctaccggtacggtcgtacgaaacggacgtacggtctagttacgttaacgttcgtacgtactacggtactactaacttacgtaacgacgtaccgaacgtacgacgtacgtaccgtaggttaaccgggttcggggaccgggtacggtaaccggtacggtaccggttaccggtacccgtaccggtaacggtcccggtaccggaacccggtacggtacccggtccccggtacccccggttgttaccccg

SEQ ID NO: 151395 - DNA, 605 bp, Homo sapiens
  misc_feature: GYAE6OF02GK4PM.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaactaccaggcaaacgcccccaaagtcatcattatgatgtctataatcggtccttacgtacggggtttacctaactcgtcttctctggcctccaacgtctcggacgacacgccctccctacgaccactctcgtcggcctccgaggctagaaacggacggaggtcgtagtactttagttactgacgacgtctacaattaacgtacgacggcacgactaacgctaacgttaccgttacgggtttccgggacgggtacgggaacaacggtcgtacggtacccgttccggtaacggtccgaacggacccgaacggtcccgtaccggtcccccgtaccggttcccg

SEQ ID NO: 151396 - DNA, 737 bp, Homo sapiens
  misc_feature: GYAE6OF02JF8DT.7.5.A05.1.454.CMB.1.raw
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgacttgctggttaataaatatctctcctggtatcaacaactaaccaggcaaaacgaccccccaaaagtccaatctaactttaattcgatcgttactaattaaactccggtacctttcgtaacgggggttttcctaaacttccggctttccgttcgtggtcctccaaacgttcctcggacgtacgaaccgggtcccgtcccccttacggacctaacgttccgttactcggggaccttacccgagggtacccgttggaaacggtacggtaacgggccttagggtaacttttaacgtttaaacgtcgtactacgccttcgtaattaacttacgaacggaccgtaggacctaagggtccctaaccgttccgtaagggttttttacccgggacggggtaccggggtacccaacgggtcgttaccggaaccggttacccgttaacggggttaccaccggttaccccggaaacccgggttcgtaccccggtcccccccggttacggttacccccgg

SEQ ID NO: 151397 - DNA, 654 bp, Homo sapiens
  misc_feature: GYAE6OF02JYCO7.7.5.A05.1.454.CMB.1.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagcgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatctcctgcactgaacccacactgacgttgctggttataaatatctctcctggtatnaacaataccaggacaaagcccccaaagtccatacattanagatgtactataatcggtccttagacgggttcctaatcggctttctccgtggtcctccgtaagtcgttacggcctacgaccggtccctccctacggaccctacttcttccgtacgggtaccgtccgtaacggtccgtaggaaacggaccgggtaacggcgttacggtaattacgttacttagctaccgtacttacaacttacgttaacgacgaccgagtacacgacctacgttacgttaacgggtttccggggtacgggacgggtaccgaacggtcgtaaccgtacccggtaccgttaccggtactacggtacccggaaaccggtccgtacccgtacccccgtccgggttaccc

SEQ ID NO: 151398 - DNA, 691 bp, Homo sapiens
  misc_feature: GYAE6OF02J2VHJ.7.5.A05.1.454.CMB.1.raw
  modified_base (235)..(235): a, c, t, g, unknown or other
  misc_feature (235)..(235): n is a, c, g, or t
tcagcgtgtctctacacgaccggtgctcgatttagatagatagacaggggggggtctcgaggaggcagcgctctcgggacgtctccaccatggcctgggctctgctattcctcacctcctcactcagggcacgagggtcgtgggcccagtctgccctgacctcagcctgcctcgtgtctgggtctccgtggactcgtcgatccaccattcctcccgtgcctacgtcggaaacccnccagtcggaccgttgccttaggttaacaaacgttcttccgtccttccgtaggtactccgaaacacttacccgaggaccaaacgcccccaaagtccacgtacattatcgattcgtactattaacgcggtccttacggacgggttccctaagtccgtacttacctctcgggtcctacgtagtccgtacgtccgactcggtccctcccgtagaccctagttccctcgtacggtcctaccggaggtccgagtacggacgtacggctacgtacgttatcgtcgacgacgtctccgacgtttacgaacgtcgtacctaacggccgtaagacccgtcgttaaccggttacgggtttccggaccgggtacggtaccaacgggttccttcccggaccgttaccggtacggttcccgacgtacccggcccgttaacggtccccggttaccccgtggttaacccccg

SEQ ID NO: 151399 - DNA, 531 bp, Homo sapiens
  misc_feature: GYAE6OF02HHHIZ.7.5.A05.1.454.CMB.1.raw
  modified_base (424)..(424): a, c, t, g, unknown or other
  misc_feature (424)..(424): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaagcccccaaagtcatcatttatgatgtctataatcggccttcgagggtttccaagtcgcttctctggctcaagtctggcgacgacgcctccctgaccatctctcgggctccgaggctgaagacgaggctgtattattactgcagctnatatacgacggcagcagctactcgtaggtttcgcgggagggaccaaggcgtcggaccgtaccgtacggtcgacgcccgaacggccgtccgtcccccgtcggtacccg

SEQ ID NO: 151400 - DNA, 679 bp, Homo sapiens
  misc_feature: GYAE6OF02F73SM.7.5.A05.1.454.CMB.1.raw
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctctgtatcaacaatacccaggacaaacgcccccaaagtccaactactattagtgtatntactaatacgtccgtcttacggttacggttactacgtcgtcttcgtcgtcgtcctacgtacgttcgcggaccgaccggtacccgtcccctaccgtacctacctaccttccgttcgggtccggtccctaccgggacgtacggtaacgggaaacggacgggtacggttacgttaacgttaagtttaaccgttacgtcgtacgtacttcctactaagttaactaacggacgtacgacgacgaccgtaccttaaccgtcggttttacggggttccgggaacggggtacggtaaccgacggtaccggtaccgttacccggtacgttaccggaccgaccgtaccggtaccgtccgtccccgtcccgtccgtaccc

SEQ ID NO: 151401 - DNA, 558 bp, Homo sapiens
  misc_feature: GYAE6OF02F40GN.7.5.A05.1.454.CMB.1.raw
  modified_base (460)..(460): a, c, t, g, unknown or other
  misc_feature (460)..(460): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtggcccagtctgccctgactcagcctgcctccgtgtctgggtcctcctggacagtcgatcaccatctcctgcactggaaccaccactgacgttgcttggttaataaatatctctcctggtatcaacaatacccagacaaacgacccccaaagtcatcatttatcgatgtctaataatccggtcctttcgtaggggtttccaattcgcttctctgctcaagtctagcgacacggccctcctcgaccatctcgtcggctcgagctagaagacgaggctagaatttagttactgtacagctactaataagtacaggcagtcancacgtcgtagggtttccggacggtacgggaccacgtcgtacgacccgttccgacggtaccgaccgaccgaccggtcctcccgtccccgtcgttacccg

SEQ ID NO: 151402 - DNA, 532 bp, Homo sapiens
  misc_feature: GYAE6OF02G5F6S.7.5.A05.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctgtatcaacaataccagcaaacgcccccaaagcatcatttatgatagtctataatcggtccttcgtaggggtttccaatcgacttctctggctcacgtctgcgacacggcctccncaccatctctggctccngctggaanacgagctgtattattactcgcagactctaatataacgacggcagcacgtcactcgtacgggtttcggcgggtacggacgaagcgtacgaccggtccacggtacgacggacccacggccgtccgtccccgtcgtacccg

SEQ ID NO: 151403 - DNA, 617 bp, Homo sapiens
  misc_feature: GYAE6OF02HR7JS.7.5.A05.1.454.CMB.1.raw
  modified_base (375)..(375): a, c, t, g, unknown or other
  misc_feature (375)..(375): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgcccctgactcagcctgcctccgtgtctgggtctcctggacagtcgatcaccatcctcctgcactggaaccacactgacgttgctggttataaatatctctcctggtatcaacaactaccaggacaaacgacccccaaagtcatcatttatgatgtctaataatcggtccttacgtaggggtttaccaacttcgcttctcgtcgctccaagtctcgcgaccncgtcctaccctcgaccatctacgtcgggtcctccgaggtctaggaacgtacgaacgggctacgatttaacttacgtacgacgacgacctactaattaacgtacgacgggtacacgacacgacctacgttcgtaacggggtttttccgggacgggtacggggaaccgtaacgtcgtacggtacccggtaccgtacggtaccgacggacccgaacggtcccgtaccggtccccgtcggtacccg

SEQ ID NO: 151404 - DNA, 614 bp, Homo sapiens
  misc_feature: GYAE6OF02GXAIW.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctgtatcaacaactacccaggacaaacgcccccaaagtcatcattatgtatgtactaatatccggtccttcgtacgggtttccaatccgtcttctctcggctaccaagttctcggaccgaccgaccggccctcccgtacgacccgtactccgttaccgtcggcctcccgaacggtcgtaaggaacggtacgaggtctagtactttaattacgtgacgactcgtctaatactacgaggcacgcacgcctacgtcggttacgggtttccggacgggacggtaccgaacggtcgtaccggtaccgtaccgtacggtaccgacggtacccggaacggtctaccccggtccccgtacggtacccg

SEQ ID NO: 151405 - DNA, 744 bp, Homo sapiens
  misc_feature: GYAE6OF02HU5FZ.7.5.A05.1.454.CMB.1.raw
  modified_base (195)..(195): a, c, t, g, unknown or other
  misc_feature (195)..(195): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctcgccctgactcagcctgcctcgtgtctgggtctctaggacngttcgatcgaccatcctcctgcacgtacggaacccactcgtagtacgttgacttaggttaataatcttctcctccgttagtactacaaactaactacccaaggtaacaaaccgtacccccaaaagtccattactaagtttactagactattaccttaagtaacgtccggtaccttttacggtaccggtttaaccagttccgtcttcctcgtcgtacctcgaacgttcgtacggtaccgacccgaccggtccctacccgtacgaacccgtagttcccgttcggtaccggtacccgttaccggacggttacgaacgggaaacggtaccggtagggtaccttaaggttactttaacggttaacgtcgtaaccgtaggtaccctaataacgttaccggtaaaccgtacggaccgtaaccggtaaccacggttaccttaaccggttacggttaacggggtttccggaacggggaaccggtacgaccggtacgtaccgtaccggtaccgtaccggcggtaccacccggttagcccgttcccggaccctcggtacc

SEQ ID NO: 151406 - DNA, 805 bp, Homo sapiens
  misc_feature: GYAE6OF02IAUK2.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctcgtgtctgggtctccgtggacagtcgatcaccatcctcctgcactggaacccacctactggaccgtttgcgttaggttaataaatacgttcctcttacctggtactacgaaacaaactaccccgaggaccaaaacggaccccctaaaagtcctaacttacctaagttttacaggtattacgttacttaattaaacgtccggtaccctttacggtaacggggttttaccaaacgttcggttacctttacgttccgttagggtaccttacccgtaaacggttcgtacggtaaccgaccgacccgggtcccttacccgtacgaccctacgtttccgtcgtacggggtccctaccgtaaccgggtcgtaacgggaaacgtaccggtaaggtccgttaggttaacgtttaacgttaccgtacggtaacctacggtacctttaccgtaaacgttaacgttaaccgtaacggggtctaacggtaccgtacggtaccttaacgtaccgttaacgggggttttaccgggaaccgggtaccgggtaaccgtaacggtccgtaaccgggttacccgtacggtaccgtaacgtaccggtaacccggtaccggtcccgttacccgtccccgtttaccggtaacccg

SEQ ID NO: 151407 - DNA, 697 bp, Homo sapiens
  misc_feature: GYAE6OF02JOY1A.7.5.A05.1.454.CMB.1.raw
  modified_base (257)..(257): a, c, t, g, unknown or other
  misc_feature (257)..(257): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctccgtgccacgtggaaacccaccatgaccgttgctggtttaataaaactntcctctccgttggtactacaacaaactacccaggtacaaaaccgaccccaaagtaccactactattactagtactagttctaattaaagtccgtccttacgtacgggtttactaagtccgtcttacgttctacggtccttaccaagttccgtaggtaccgactaccggcccttaccccgtccgtaacctactccttccgtacgggtaccttcccgacgggtccgtaaggaacgacggtaacgggtctacgtaagtttaaacgttacgtacgttcaccggtctaccaattacgaaaccgttacgacgaccagtaccgacttaccgtacgttaacgggtttccgggacggtacgggtaaccgaacggtccgtacgtaaccggttccgtacggttacgtaaccgcccggtaacgccggtacccgtcccccgtacggttacccg

SEQ ID NO: 151408 - DNA, 536 bp, Homo sapiens
  misc_feature: GYAE6OF02GT5HL.7.5.A05.1.454.CMB.1.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctccgtgtctgggtctcctggacagtcgatcaccatctcctgccactggaacccaccactgacgttgcttggttaataaatntctctcctggtatcaacaatacccaggcaaacgcccccaaagtcatcatttatgatgtctataatcgcttcgagggttccaatcgcttctctgctcagtctgcacacgcctccngacctatctcgtcggcctccgaggtctggaacgacggacggctgtatttaacttacgtgactacgtctactatactacgaggcagcacgactaccgtcgttaggtttccggacggtacggaccacggctacgaccgtcgtacgtcacgccgaagcctacgtccccgtgtccc

SEQ ID NO: 151409 - DNA, 558 bp, Homo sapiens
  misc_feature: GYAE6OF02FUX10.7.5.A05.1.454.CMB.1.raw
  modified_base (234)..(234): a, c, t, g, unknown or other
  misc_feature (234)..(234): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttnctgttaataaatatctctcctggtatcaacaataccaggcaaagcccccaaagtcatcattatgatgtctaataagtcgccttcgtacggggtttccaagtcgtcttctctcggctccaagttctggacgacgaccggtccctccctcgacctactcgtcgtcgggctccgacggtctaggaacgacggacggtctaggtactttacttaacgtcgacagtcctactataactacaggcagcagcactcgtaggtttcgacgggacgacacggcgtacgaccgtacgtacggtactacgaccgacgcgtccgccccgtcgtacc

SEQ ID NO: 151410 - DNA, 585 bp, Homo sapiens
  misc_feature: GYAE6OF02FVBNC.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaatacccaggcaaacgcccccaaagtcatcatttatgatgtctataatcgccttctaggggttccaatcgcttctctgctcaagtctggcacacggcctccctgaccatctctggcctcaggctgaagacgaggctagattatactgcagctcattaatacgaggtacagacacgtaccacgttaccgtagggttttacccggggcgggtacggggaaccctaacgggtcctacgggtaccccgttaccgttacgggtacccgtacggtaacccccggaaagggtccccgtacccggtccccccgtacgggttaccccg

SEQ ID NO: 151411 - DNA, 656 bp, Homo sapiens
  misc_feature: GYAE6OF02G72C3.7.5.A05.1.454.CMB.1.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (495)..(495): a, c, t, g, unknown or other
  misc_feature (495)..(495): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacgagggtcgtgggcccagtctcgccctgacctcagcctgcctccgtgtcgtgggtctccgtggacagtcgatcacntctcctgccactcggaacccaccacgtcgacgttgcgttagttaataaatctctctcgtgtactacaaactaacaccgagacaaaccgaccccaaagtcatctatttancgtatgtacttaactaacgtccgtaccttacggtacgggtttacctaacgttcgtcctttactcgtcgtaccttacgaagttcgacggacgaccgtaccggtccctacgtacgactacgtctcgtcggacctcgacggctacggaacgcggtagtcgttaagttacttacgttacnggactacggtactataacgtaacacggtagaccgacgacgacttaccgtacgttcggttacggggtccgggaacgtaccggaacgtaacggtccggtacgtacccggtacgttacggaccgacccgaaccgtcggaccctcccgtaccccggtgtaacccg

SEQ ID NO: 151412 - DNA, 599 bp, Homo sapiens
  misc_feature: GYAE6OF02I7QET.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttataaatntctctcctggtatcaacaactaccaggcaaacgcccccaaagtcatctattatgatgtctataactcgtccttcgagggtttccaatcgtcttctctgctcaagtctggcgacacgcctcctgaccatctcgtcgggtcctccgaggctacgaagacgaggtctagtatttacttactgacgagtcctacacttactaacgacggtacgacgctaacgctaaccgtcggttaccgggttttacgggacggggtacgggaccgtaacggccgttaccggtaacccgttccggtaacggtaccgtaccggtacccgtaacggtccgtacccggtcccccgttacgggtacccc

SEQ ID NO: 151413 - DNA, 570 bp, Homo sapiens
  misc_feature: GYAE6OF02HJIEZ.7.5.A05.1.454.CMB.1.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (448)..(448): a, c, t, g, unknown or other
  misc_feature (448)..(448): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaacccaccactgacgttgcttaggttaataaatatctctctgtactacaacaataccaggacaaacgacccccaaagtcatactattatgatgtctaatatcgtcctgtagggttacaatcgnttctntgctacaagtctgcgacacggcctccncgaccntctcgtcggtctaccgaggctaggaacgacggtagcgtagtaatttacttactgacagtctacaatanaagtacgctagctagcctacgtgtacgggttcgggacggacgggaactaacggcctacggtacccgttacgtacggtacaccggtaccgaacgggtccctcccggtaccccgttcgtacccg

SEQ ID NO: 151414 - DNA, 658 bp, Homo sapiens
  misc_feature: GYAE6OF02HKSD5.7.5.A05.1.454.CMB.1.raw
  modified_base (267)..(267): a, c, t, g, unknown or other
  misc_feature (267)..(267): n is a, c, g, or t
  modified_base (528)..(528): a, c, t, g, unknown or other
  misc_feature (528)..(528): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcagggcacgagggtcgtgggcccagtctcgccctgactcagcctgccctccgtgtctgggtcctcccgtggacagtcgatccaccatcctcctgctacgtcggaacccaccatcggtaccgtttgccttagggttttaaanaaaattctactccttacctggttactacaaacaactaccgaaggacaaaaccgacccccaaagtactaactcttaattactagtatgttactaataatccggtacttacgtagggttacctaacgtcgtcttctctcgcttacaacgttcgtggtccgacgaccgtccctccgtccgaccgactccgttcgacggtcctaccgacggtcgtacgtaacggaacgtacggtccgtagtaattacgttaacgttcgacacgtntacatagttaacgagcgaagcaanctaccgtnttcggtacggtacggacgggaaccgacgtcgaccggtacgtaccgtacggtacgtaaccggcccgttaacggaccgttaccgtccccgtcggtacccg

SEQ ID NO: 151415 - DNA, 571 bp, Homo sapiens
  misc_feature: GYAE6OF02HMCER.7.5.A05.1.454.CMB.1.raw
  modified_base (250)..(250): a, c, t, g, unknown or other
  misc_feature (250)..(250): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttaataaatntctctccgtggtactcaacaactaccaggacaaacgacccccaaagtcatcatttatgatgtctaatatcgtccttcgagggttacagtcgcttctntcgctcaagtcgnggcacgtaccgtcctccctagaccctattcctcgtcggcctccgacgtcgtagaacggacgagtctagtattagttacgtgacagtctagtatacacgacgtcagcagcctaacgtcgtacgggtttcggacgggtacggacgaacggtcgtaccgtccggtaacgtacggcgacgccggtaacgtcccgtaccggcccccgttacgtacc

SEQ ID NO: 151416 - DNA, 722 bp, Homo sapiens
  misc_feature: GYAE6OF02HOE5H.7.5.A05.1.454.CMB.1.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
tcagcgtgtctctacacgaccggtgctcgatttagatagatagacgaggggggggggtctcaggaggcagcgctctcgggacgtctccaccatggcctgggctctgctattcctcacccctcctcactcagggcacgagggtcgtgggcccagtctgccctgactcagcctgccctccgtgtctgggtcctccgtggacagtcgatcacctatcctcctgcactggaacccaccactgacgttgctagttaanaactntctcctcgtgtactacaacaactaccgaggaccaaaccgaccccaaagtccatactaatttangtatgtactaataacgtccgtcgttacgtacgggttcaagtcgtcttctacgtcggtcctacgtaaggtccgtaggtaccgaaccgaccggtacccctaccctacgtaccctatcccgtcggtccggtcctaccgaggtacgtaacggtaaacggacgtacggtcttagtaacttacgttaacgtgactagactacgtaactacgtacggaaggaccacggaactaccggtaactacggtttacgttacggggtttaacccggggaccgggtaacgggtaacccgtaagggtacccgtaccggttaaccccgggttaccggttaaaccgggtaccgtaaacccggtacccggaaaccgggttcccccggtacccgtaccccccggttccggttaaccccgg

SEQ ID NO: 151417 - DNA, 553 bp, Homo sapiens
  misc_feature: GYAE6OF02IOBJI.7.5.A05.1.454.CMB.1.raw
  modified_base (433)..(433): a, c, t, g, unknown or other
  misc_feature (433)..(433): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataatatctctcctgtatacaacaatacccagacaaacgacccccaaagtcatcatttatgatgtactataatcggccttcgagggtttccaatcgtcttctctgctacaagtctggcacacgtcctccctgaccatctcgtcgggctccgaggctagaagacgaggctagtattattacgtcgcagtctanatatacgaggcagcagctactcgtagggtttcggaccggaggtaaccgaggtccgtaccggtaccgtaccgtacggtaccgacgacccgaacggtccctaccggtcccccgtcggtaccc

SEQ ID NO: 151418 - DNA, 695 bp, Homo sapiens
  misc_feature: GYAE6OF02HF36U.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctcgccctgactcagcctgcctccgtgtctgggtctccgtggacngtcgatcacctatcctctgcacgtggaacccaccactcgacgttgcttaggttaataatatctctccgtggtactacaacaactaccagacaaacgacccctaagtcactactattatgatgtactaatacgtccggtcttagtacgggttactagtcgtcttactcgtacggacctacgtaacgtcgtacggaccgtaaccgacccggtcccttacccgtacgtaaccctacgtttccgtccgggtacgggtcctacccgtacgggtacgtaacgggaacggtacggtacgggtactacgttaaactttaaccgttacgtacgtactcgtaccttactaacttaacgtaccggacggacgtacgacgtacggtacctaaccggttcgtaacgggtttacgggaccgggtacggtaaccgtaacgtccggtaccggtaccgttacggaacggttcgaccggacccgtacggtacccgtcccgtccccgtacgttacccg

SEQ ID NO: 151419 - DNA, 798 bp, Homo sapiens
  misc_feature: GYAE6OF02JIJCN.7.5.A05.1.454.CMB.1.raw
  modified_base (223)..(223): a, c, t, g, unknown or other
  misc_feature (223)..(223): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccnccactgacgttgctggttataaatatcctctcctggtactcaacaatacccaggcaaacgcccccaaagtcatcatttangatgtctataactcgaccttntagggttccaatccgcttactcgtggcctccaagtctggtcgacaccggccctacctacgaccctaacgtcctcgtacggggtcccttacccggaacgggtacctacgggtaaaacggaccgggtacgggtacttacgggttaaatttaaccgttttaaccgttacggtacccgtaacgtccggttaacccgtaacttaacgtttaaacccggaacgggttacccgaacgggtaccccgttaaacggacccgttaacccgtttaccggttaaaccggggggttttttacccgggggaacccggggttaaacgggggaacccccgttaaagggtccccggttaacccgggttaaacccccggttacccggttaaacgggggtttaccccgaaacccgggttacccccgggaaaaccgggttccccccggtttaccccggggttaccccccccccgtttccggggttaaccccccg

SEQ ID NO: 151420 - DNA, 620 bp, Homo sapiens
  misc_feature: GYAE6OF02HBO0N.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactggacgttcgcttaggttaataaattactctctccgtaggtatacaacaactaccaggacaaacgacccccaaagtacactactatttatagatgtactaataacgtcggtccttacgtacggggtttacctaacgtcgtcttcttcgtcggtactaccaacgtctcggaccgacgaccggcccttcccgtacgaccctactcgtcgtcggcctccgacggtctacggaacgacggagtacgtagtacgttattacgtagacgacgtactactataactacgagacgacgacacgactacgttacgtacgggtttcgggacggacggacgacgtcgtacggtaccgtaccgtacggacacggaccgacgtccgtccgtccccgtcgtacccg

SEQ ID NO: 151421 - DNA, 565 bp, Homo sapiens
  misc_feature: GYAE6OF02I68P1.7.5.A05.1.454.CMB.1.raw
  modified_base (246)..(246): a, c, t, g, unknown or other
  misc_feature (246)..(246): n is a, c, g, or t
  modified_base (382)..(382): a, c, t, g, unknown or other
  misc_feature (382)..(382): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctggtatcaacaatacccaggcaaacgcccccaaagtcactcatttatgatgtctataatcggtccttcgtagggtttccaatcgcttctctgctcatctggcgcacgcctccctgccatctctggctcngctgacgacgaggctagtacttattactcgcacgtctctactaactacgacggacagcaggtccaacgttcgaagggttttccgggacgggtacgggaaccgaacggtccgtacggtacccgtaccgttacggtaccgtacgacccgaaccggtccgtcccggtacccccgttcccggtaccc

SEQ ID NO: 151422 - DNA, 567 bp, Homo sapiens
  misc_feature: GYAE6OF02JHUJP.7.5.A05.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttanaaatnctctctggtatcaacaatacccaggacaaacgcccccaaagtcatcaactttatgtactgtactataactcggaccttcgtacggggtttcctaatccggtacttctcgtggtcctcaagtctcggcgaccgaccggcctccctacgacctactctacgtcggcctccagggcttagaacgacgacggtctagacttaattactcgctagtctctaagttacagacgcagcacgctactacgtagggttcggacggacggacgacggcgtaccgtacggtcctaggtcacgacccgacggtctacccggtccctcggtacc

SEQ ID NO: 151423 - DNA, 598 bp, Homo sapiens
  misc_feature: GYAE6OF02GJSMA.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccatgacgttgcttggttaataaatatctctctggtatcaacaatacccaggacaaacgcccccaaagtcatcatttatgatgtctataatcggcttcgagggtttccaatcgtcttctactgtctaccgtaagtctggacaccgaccggtccctcccgtcgacccacttcgtcgtcggggtcctccgagggctaggaagacggaggtcctagtaactttattacgtggacagctactatactacgaggcagcaggcctaacttcgtagggttttccgggacgggtacgggaccgaaggtctaacggtacccgttaccggtacggtaccgtacggaccccgtaacgggtcccgtcccggtcccccgttgggtaccc

SEQ ID NO: 151424 - DNA, 600 bp, Homo sapiens
  misc_feature: GYAE6OF02GPNJN.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccagacaaacgccccaaagtcatcattatgatgtactataactcgtccttcgtacgggtttccaatcgtcttctctggctaccgaagtcgtcggcgacaccggtccctccctcgaccactctcgtcgggtcctccgaggtctaggaacgacggacggactagtattaattacgtgactagtctactatactacgagcagcagacctacgtaccgttagggtttccgggacgggtacgggaaccgtaacggtccgtaacggtacccgtacggttacggtccgtaacggacccggtaacggtcccgtacccggtcccccgttaccggtacccg

SEQ ID NO: 151425 - DNA, 606 bp, Homo sapiens
  misc_feature: GYAE6OF02JIDRI.7.5.A05.1.454.CMB.1.raw
  modified_base (131)..(131): a, c, t, g, unknown or other
  misc_feature (131)..(131): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
tcagcgtgtctctacacgaccggtgctcgatttagatagatagacagggggggtctcaggaggcagcgctctcgggacgtctccaccatggcctgggctctgctattcctcaccctctcactcagggcacngggtctggcccagtctgccctgacctcagcctggcctccgtgtcctgggtctcctggacagtcatccacctatcctcctgccacgttggaacccacnctggacgttncctaggttaanaaactcgtcctctcgtgtactcaactactaccgagacaacgacccaagtcatctattactgactgtactatacgtcgtccttacgacggttcatcgtctcgtctcgtcctactacgtctcgacacgtccgtccctccgtacgtacctactcgtcgtcgtacctcgacgtccgtacgaacgtacgtacgtcgtacgtactttacgtacgtcgtacgtacgtctactactacgacgtagaccgtagtaccgacgtctacgtacgttacggttcggaccggtagtaccgagtccgtacgtaccgtaccgtacggtaccgtaccggtaccgtacggtcccgtaccggtcccgttcggtacc

SEQ ID NO: 151426 - DNA, 520 bp, Homo sapiens
  misc_feature: GYAE6OF02GI57F.7.5.A05.1.454.CMB.1.raw
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggcagtcgatcaccatctcctgcactggaaccaccactgacgttgctggttataaatatctctcctggtatcaacaataccagcaaagcccccaaagtcatcatttatgatgtactataatcggtccttacgagggtttaccaagtcgcttctctggctcaagtcngcacacgcctccnaccatctcgtggctccgaggctgaagacgagctgtattattactgcagctnatatacgagcagcagcacgtcgtagggtttcggcggtacggacaacggcgtacggtaccgtccgtaggtaccacgcccgaaggcctcgccccgtacgtccg

SEQ ID NO: 151427 - DNA, 617 bp, Homo sapiens
  misc_feature: GYAE6OF02G6IOR.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctggtatcaacaactaccaggacaaacgaccccaaagtcatcattatgatgtctaataactcggtccttcgtacggggtttaccaatccgtctttctcgtcggcctacaagtctggccgacaccggtccctccctacgaccctactctcgtcgggcctccgaggctagaacgacgaggcttagtattaacttacgtcgactagtacctactaacttacgtaacgtacgcgtaacgcgaacgactaaccgttacgttacggggtttacgggacgggtaccgggaacgtaacgtcggtacggtacccgtacgtacggtaccgaccggtacccgaacggtcccgtacccgtaccccgtcggtaccc

SEQ ID NO: 151428 - DNA, 641 bp, Homo sapiens
  misc_feature: GYAE6OF02JFRRG.7.5.A05.1.454.CMB.1.raw
  modified_base (445)..(445): a, c, t, g, unknown or other
  misc_feature (445)..(445): n is a, c, g, or t
tcagcgtgtctctacacgaccggtgctcgatttagatagatagacaggggggggatctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctctgcactcggaaccacactgacgttgctaggttataatatctctctgtatacaacaactaccagacaaacgacccaaagcatactattacagtactagtactaacgtactccggtaccgttcggtaacggggttaccctaagttccgtcttcctcgtcgtacctccgtaacgtcgtacggcgtaaccgtaccggacccttcccgtacgtacctacgttccgtcggcggtccgtaccgnggtacgtacgaacggaacgtacggtctagtaacttacttacgcgtaacgtcgtactactaaagtactacgacgtacgacgacgtacgacgtcgtaacggttcgggttacggacgggtaacggtacccggacgtaccggtccgtaccggtactacggaccgccgtaccgtacgtacccggtaccgtccccggtaccg

SEQ ID NO: 151429 - DNA, 660 bp, Homo sapiens
  misc_feature: GYAE6OF02FGVYB.7.5.A05.1.454.CMB.1.raw
  modified_base (311)..(311): a, c, t, g, unknown or other
  misc_feature (311)..(311): n is a, c, g, or t
  modified_base (479)..(479): a, c, t, g, unknown or other
  misc_feature (479)..(479): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgtcctgactcagcctgcctccgtgtctgggtctccgtggacagtcgatcaccatctcctgccactggaacccaccactgaccgtttgcttggttaataaatatcctctcctggtatcaacaatacccaggcaaacgccccccaaagtcatactatttangatgtctataatcggtccttcgtacggggttaccaactcgtcgttctcgtggtcctaccgaagttccgtaggacgacgaccggccctcccgtacgaccctaattcctacgtcgggtacctccgaacgggtctaggaacgacggacgggtactgtaactttagttaacngtacgacgcttacaattacgtaacacgggtaccaggtaccaacggacctaaccgttacgttaccggggttttcgggaccggggtacgggaaccgaacggttccgacggttaacccggaccgttacggtacccgacggaccccgtaacggtcccctacccgggtcccccctacgggtacccc

SEQ ID NO: 151430 - DNA, 808 bp, Homo sapiens
  misc_feature: GYAE6OF02JMJSJ.7.5.A05.1.454.CMB.1.raw
tcagcgtgtctctacacgaccggtgctcgatttagatagatagacagggggggggtcgtcgaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgacacgtcggaacccaccactcgacgttgccttaggttaataaatacttcctctccgttaggtattccaaactaactaccccgaaggtacaaaccgacccccaaagtactactactatttatacgtattcgtacttaataacgtcgggtacccttacgtacggggtttacctaacgttcgcctttacttccgtcggtaccttaccaaacgttctcggtaccgaccgtacggtccccgttaccgtacgaacccttacgttcccgttcggttacgggtccttacccgtagggtacccgttaacggaacgggtaacggtacgggtaccgttaacggttaacttttaaccggtttaaacgtccggtacgtaaccggtccttaaccgtaacgtttaaccggaacgttaccggggactaaccgggtacgtaaccgtacccgtaccggtttaacgttaccgggggttttaccgggtaacgggacccggggttaaacctaacgggtcccggttaacggaccccggtttaccgttaacggtacccggtacccgtaacccggtacggttacccctaccccgggttaccccggtaccggtttcccg

SEQ ID NO: 151431 - DNA, 648 bp, Homo sapiens
  misc_feature: GYAE6OF02HXV7H.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactggaacccacactgacgttgctgttaataatatctctcctgtactacaacaactaccgaggacaaacgaccccaaagtcaatctaatttatagtatgtatatatcgtccttacgtacgggttacaatcgtcttactctcgtctactagtcgtagacgaccacggtccctccgtacgaccctatacctcgtacggtcctacgaggtactaggaacggtaacggacggtcgttagtaatttaacgttacgtgacgtacgtactactaacttacgtacgtacgtacgagtaccgacgacgtaccgttacggttacgggttttccgggacgggtaacggaaccggtacgtaaccggtccggtaacccggttccggttaacggtaccgaaccgggacccgtaaccgggtcccgtacccggtcccccgtacggtaacccg

SEQ ID NO: 151432 - DNA, 622 bp, Homo sapiens
  misc_feature: GYAE6OF02IUBQ8.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactggaaccaccactgacgttgctggtaataaatntctctcctggtatcaacaatacccagacaaacgcccccaaagtcatcatttatgatgtctaataactcgtccttacgtacgggtttccaactcgtacttcttacgtggctaccaacgtctcggccgaacgaccggtccctccctcgaccactcgtacgtcgggtcctccgacgtctaggaagacggacgggtctacgtactttaagttacgtagcgtagtcctacgtaactataccgacggaccaggaccaaggccctaacgtaccgttacgggtttcgggaccgggtacggaaccgtaacggccgtacggtacccgtccgttacgggacacggtaccccgaacggtcctcccggtaccccgtccggtacccg

SEQ ID NO: 151433 - DNA, 527 bp, Homo sapiens
  misc_feature: GYAE6OF02FY6JE.7.5.A05.1.454.CMB.1.raw
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaatacccaggcaaacgcccccaaagtcatcatttatgatgtctataactcggcttactagggttccaatccgtcttctctggctccaagtctggacgacacggcctccctgacccatccnctggcncagctagaagcgagctagattattactgacngctcatactacgagtacagacagcactcgtagtttcgggnggtacggacaagtcncgtaccgtcctaggtccgacgcccgaacggctccggccccctggtcccg

SEQ ID NO: 151434 - DNA, 815 bp, Homo sapiens
  misc_feature: GYAE6OF02IACM3.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggcagtcgatcaccactctcctcgcacgtacggaacccacctacgtacgtaccgttcgtacttagggttaattaaaactaacttccttaccttccgttggttaacttaaccaaactaaactaaccccgaacggaaccgaaaaacccgtaccccccaaaagttaccctaattaccttaattttataggtaactgttactataacgtccggttacctttaccggtacgggtttacctaacgttcgtcctttcgttccgtcggtctacctaacggttcgtcggtacgaccgtaccgtcccttacccgtacgaccctacgtccgtcggttcgggtaccctacggtaacgggtaccttaacgggaaacggaccggtaacgggacctttggttaaactttaacgttaccgttgtacgtactccgttaaacacgttacgtaacgaacgggtacgtacggaccgtaacgtacccgtaacgtttacccggttacggggtttaccgggaccggggttaaccgggaaccgtaaccggcccggttaacccggtaacccggtaccgggttaaccgtaccgaccggtaaccccggtaaccgggtacccctaccccgggttacccccgtccgttaaccccgg

SEQ ID NO: 151435 - DNA, 864 bp, Homo sapiens
  misc_feature: GYAE6OF02FH4Y1.7.5.A05.1.454.CMB.1.raw
  modified_base (189)..(189): a, c, t, g, unknown or other
  misc_feature (189)..(189): n is a, c, g, or t
tcagcgtgtctctacacgaccggtgctcgatttagatagatagacgagggggggggttctcaggaggcagcgctctcgggacgtctccaccatggcctgggctctgctattcctcacctcctcactcagggcacagggtctggccagtctgcctgactcagcctgcctcgtgtctggtctccgtggacngtcgatcaccatcctcctgccctacgtcgggaacccacctacgtgaccgtttgccttagggtttaactaaaacttctccgttcctaccgtaggttaactacctaaacctaaccgttaaccccgaacgggtaacccaaaacccggtaccccccctaaaacggttcctaaacgttacctaattttaacgtacggttaacttacggttaccttaaagttaaccggttacccgggttacccttacgggtaaaccggggttttcccaaaccgttccggttcctttaccgttccgtacgggttacctaccgtaacgttccggtacggaccgtaaccggacccggtaccctcccgtacgaccctacgtccgtacgtaccgggtcctaccgtacggtaccgtaacggaacggtaaccggtacgggttaccgttaagttaccgtttaacgttttaaccgcggtaacccgtacgtaccgttaccaaacgttaaagtaacccggtaacgggtacaacgttaccaacggttaccgtaaacccgttacgggttaaccggggtttccggggaacgggtaaccggaccgtaacgggtaacccggttaccggacccggtttaacgtacgggtacccgtcgggaaacccttccgggaccccgttccccggtacccccgtaggtttaaccccg

SEQ ID NO: 151436 - DNA, 600 bp, Homo sapiens
  misc_feature: GYAE6OF02HWHCD.7.5.A05.1.454.CMB.1.raw
  modified_base (177)..(177): a, c, t, g, unknown or other
  misc_feature (177)..(177): n is a, c, g, or t
  modified_base (354)..(354): a, c, t, g, unknown or other
  misc_feature (354)..(354): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtntctgggtctcctggacagtcgatcaccatctcctgcactgaaccacactgacttgctaggtataaatatctctcctgtatcaaacaataccaggacaaacgacccccaaagtcaatacatttatagatgtactataatcgaccttcgagggttcaactctcttatctgctcaagtcngacgacacgtcctcctcgaccatctcgtcggctacacggcgtgtaacgaacgtcggactagtattaattacgtagctagtacgtactaatataacgacggtacgacgacgaacgtacaacgtacgtagggttttacggacggggacggtaaccggaagtacggtccgtaacccggtaccgttaacggtaccgtaccggacccggtaaccggtccgtacccggtacccccgtacccggttaaccccg

SEQ ID NO: 151437 - DNA, 610 bp, Homo sapiens
  misc_feature: GYAE6OF02HU5VD.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactcggaacccaccactgacgttgctaggttaataatntctctcctggtactcaacaactaccaggacaaacgacccccaaagtcatactatttatgatgtactataatccgtccttgtacggggtttccaatcgtcttctctgctcagtctgcgacacggcctccgtcgaccactctcgtcggcctcgaggtcaggaagacgacggctagtattaattactgcagtcataattactacgaggacacgacacgacctacgtcgttacggggttttaccgggaccgggtacgggaacccgaaggtccgtaccggtaacccggttacgttaccgggtaccgaccggtaccccggaacgggtcccgtacccggtccccccgttaccgggtaaccccg

SEQ ID NO: 151438 - DNA, 616 bp, Homo sapiens
  misc_feature: GYAE6OF02GQF9B.7.5.A05.1.454.CMB.1.raw
  modified_base (254)..(254): a, c, t, g, unknown or other
  misc_feature (254)..(254): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaacccaccactgaccgttgacttggttaataaaatntctactcctggtatcaaacaatacccaggcaaacgcccccaaagtcatcattatgatgtactataatcgcttacgagggttccaagtcgcttctctgctcctaagtctggcacgacggcctccctgacactctctacggctccgaggctagaacgacgaggctagtattacttacgtgacgagtactcgtaatacgaacgtacggacaggacacggactacgttccttaacggggttttccgggaccgggtaacgggaaccgtaacggtaccgtaacggtaccccggttaccgtaacggttaaccgtaaccggacccggtaaccgggtacccgttacccggtccccccgttagggttacccc

SEQ ID NO: 151439 - DNA, 712 bp, Homo sapiens
  misc_feature: GYAE6OF02HU22F.7.5.A05.1.454.CMB.1.raw
  modified_base (252)..(252): a, c, t, g, unknown or other
  misc_feature (252)..(252): n is a, c, g, or t
tcagcgtgtctctacacgaccggtgctcgatttagatagatagacaggggggggggtctcaggaggcagcgctctcgggacgtctccaccatggcctgggctctgctattcctcaccctctcactcagggcacagggtcgtgggcccagtctgccctgactcagcctgcctccgtgtctgggtctccgtggacagtcgatcaccatcctcctgcactcggaaccacactggacgttgctaggttaataaatntctactccgtggtactacaactaactaccaggcaaaccgacccccaaagtcaatctaatttatagtatgtactaataacgtccggtcctttcgtacgggtttaccaacgtcgtcttctcgtcgtcctaccgtaacgtcgtacggaccgtaccgaccgtccctccctcgacctactccgtccgtggcctcgacgtctacggaagtaccggagtcgtagtattaacgttactgctacgtctacgtaactagtaacacggtacaacgtacgacgtaccaaccgttttaccgggtaacggggtttacccggggacggtaaccggggtaccgtaacggtaccggtaacccggttaaccccggttcccgggttaaaccggtacccggtaaccccgggtaacccggtaaacccgggtttccccggttaacccccgggtaccccccggtttacccgggttaacccccg

SEQ ID NO: 151440 - DNA, 842 bp, Homo sapiens
  misc_feature: GYAE6OF02ICWOM.7.5.A05.1.454.CMB.1.raw
  modified_base (252)..(252): a, c, t, g, unknown or other
  misc_feature (252)..(252): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgccctgactcagcctgcctcgtgtcgtgggtctccgtggcagtcgatcaccatcctcctgcactcggaaccacactgtacgttgcttaggttaataatntctctcgtgtactacaacaactaccagacaaaccgccccaaagtccatactatttatgtattcgtactagttaacgtccggtaccgtttacggtacgggtttacctaacgttcgtacctttcgtccgtcggtaccttacccgtaacgttcgtaacgggaccgtaaccggacccggttaccctcccgtacgtaaccctagtttcccgttcgggtacggttcctaccggacggtcgtaacgggtaaacggtaaccgggaggttaccgttaaggtttaacttttaaacgtttaaccggttacggtaacgtaccggttaccttaaaccgtaaagtttaaccggttaacggtaacgggtaccgaaccggtaccgtaaccgtaaccgtttaacccggttaccggggtttaacggggttttacccgggggaacccggggtaaacggggtaacccgtaaccggggttacccggttaacccgggtaaccccgggtttaacccggtttaaaccgggttaccccggaaaccgggttaccccgggtaaacccgggttccccggtacccccgggttacccccggttaccggtttaacccccgg

SEQ ID NO: 151441 - DNA, 663 bp, Homo sapiens
  misc_feature: GYAE6OF02G6FL7.7.5.A05.1.454.CMB.1.raw
  modified_base (112)..(112): a, c, t, g, unknown or other
  misc_feature (112)..(112): n is a, c, g, or t
  modified_base (264)..(264): a, c, t, g, unknown or other
  misc_feature (264)..(264): n is a, c, g, or t
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
tcagcgtgtctctacacgaccggtgctcgatttagatagatagacagggggggggtctcaggaggcagcgctctcgggacgtctccaccatggcctgggctctgctattccncaccctctcactcagggcacgagggtcgtcgggcccagtctgccctgactcagcctgcctccgtgtcgtgggtcctccgtggacagtcgatccacatctcctgcacgtcggaacccaccacgtgtaccgttgcgttaggtttaaataaattntcctctaccgttggtaactaccaaactaactaccgagaccaaaaccgacccccgtaaagtacattacgtaatttatcgtaattcgttactaattaacgtccggtaccttacggtacggggtttaccacttccgtcttctcgtcgtacctacctaaggtcgtcggaccgaaccgaccggtccctaccgtcaccgtacttccgtcggtcggctacccgaggcgtaagacggacgacggctagtactttacgttacngactacgctanacttactacgagacgactgcgactgtacggttacgggttaccggacggtacgggaacttcggtaccgtacggtaccggttcgtaacggtccggaaccgtccggaacgccccgtaccggtccccttacggtaccc

SEQ ID NO: 151442 - DNA, 569 bp, Homo sapiens
  misc_feature: GYAE6OF02F76HT.7.5.A05.1.454.CMB.1.raw
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaactaccaggacaaacgcccccaaagtcatcatttangatgtactataatcgccttcgagggtttcaatcgcttctctgctacagtctggcgacacggtccctccctgacctatctcgtcgggcctccgaggctaggaacgacgaggtctagtattagttactgcagtctactatanacgtagcagcacgcacgtcgtaacggtttcgggacgggtacggaccgaacgtccgtaccgtacccggtaccgttacggaccgtacggacccgtaaccggcctacccggtaccccgttccggtacccg

SEQ ID NO: 151443 - DNA, 551 bp, Homo sapiens
  misc_feature: GYAE6OF02F3SHH.7.5.A05.1.454.CMB.1.raw
  modified_base (307)..(307): a, c, t, g, unknown or other
  misc_feature (307)..(307): n is a, c, g, or t
  modified_base (430)..(430): a, c, t, g, unknown or other
  misc_feature (430)..(430): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaacccaccactgacgttgcttggttaataaatctctctcctggtatcaacaactacccaggacaaacgcccccaaagtcatcatttangatgtctataatcgtccttcgtagggtttccaatcgcttctctgctcaagtctggcgacacggcctcccgtcgacctactctcgtcgggctccgagcgtgaagacggagcgtgacttattacngctacgctacattacacgagcagcagcactcgtgggttccggcgggacggaccgtaggcgttaccggaccggtccgtacggtcacggcccgaacggtccgtaccggccccgttcgtacccg

SEQ ID NO: 151444 - DNA, 667 bp, Homo sapiens
  misc_feature: GYAE6OF02IGNH5.7.5.A05.1.454.CMB.1.raw
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcagggcacgagggtcgtcgggcccagtctcgccctagacctcacgcctgcctccggtgtcgtgggtcctccgtaggactagtcgactcaacctatcctccgtgccacgtacggaaacccacctacgttggtaaccggtgtaccgttaaggtttaaataaaattctttcctccgttcctaggttacaactaaactaaactaccccgaacggaacccaaacgaaccccccgaaaagttcaactcctaagttactagactagttactaactacgtcgtaccgttcgtaggttaccaagtctcttcncgtcgtccactagttcngacgaacctccgcctccgatcctactcgtacggtcgactccgacggtacgacggaacgacggacgttcgtagtaacttagttcgtagctagcttacataacgtaacgcgtacaacgcacgcgtaccgtaggttcggttcggaacggacggacgacggtccgtacgtccgggttaccgtagtacccgcgtacccgcggtaccgcccgtacccgtcggtacc

SEQ ID NO: 151445 - DNA, 787 bp, Homo sapiens
  misc_feature: GYAE6OF02IFQWX.7.5.A05.1.454.CMB.1.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcacgtgaaccnccactgacgttgcttaggttataaatntctctcctgtatcaacaactaccagacaaacgacccccaagtcatctaatttatgtatgttactaatactcggtccttacggtacgggtttaccaacttcgtcttctcgtcggtctaccgaagtcctggcgacgaccggtccctccgtacgaccctacgttccgtacgtcgggccttacccgacggtacgtacggaaacgggacggtacgggtaccgttaggttaaactttaaccgtttacgtcggtaaccgtacggtacccttaacgtaaacttaacgtaaccggaacgggtaccgtaacggtacccgtaacggtacccttaaacccgtttccgggttttaaaccgggggtttttccgggggaaccgggggtaacccggggtaaacccgtaacccgggttaccggtaaccccggggttaaacccccggtttacccgggttaaacccgggttaaccccgggaacccgggtaacccccgggtaaacgggtcccccggttacccccgggttacccccccccggttacggttacccccgg

SEQ ID NO: 151446 - DNA, 651 bp, Homo sapiens
  misc_feature: GYAE6OF02HJGCZ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttaataaatatcctctcctggtactacaacaatacccaggaccaaacgcccccaaagtcatacattatgatgtctataactcggtccttctacgggttcaatcgtcttctctgctacagtctggcgacacgcctcctcgaccattccgtcgtacgggtcctccgacggtctacggaaacggtaccggtagggtaccgttagtaattttaacgttaccgttcggaccgtaggtacctacgtaattaacgtaaccgtacgggtaccaacggtaccgaacgtaccctaaccgttacggtacggggttttacggaccggggacggtaaccgaacggtccgtacggtaccccggttaccgttaacggtaccgacggtacccgtaacggtcctacccggtcccccgttgggtaacccc

SEQ ID NO: 151447 - DNA, 670 bp, Homo sapiens
  misc_feature: GYAE6OF02HO79F.7.5.A05.1.454.CMB.1.raw
  modified_base (544)..(544): a, c, t, g, unknown or other
  misc_feature (544)..(544): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttaggttaataaatatctctccgttaggtactacaacaactaccaggacaaacgacccccaaagtacactactatttatcgtatgtactactaagtccggtcttacgtacgggtttccaagtcgtcttctcgtcggcttacctaagtctcggacgtaccgaccggtccttacccgtagacccctattccgttcgtcggggtacctaccggtacggtacgtagaacggtacggaagggtcgtacggttaattacgtttaacgtcgacgtacgtcctactaagttaactaacggtacgacgacacggaacnccgtacgttacggttacgggttttccgggacgggtaacgaccgtaacggtcctaccggtacccgttacgtaccgggtcgaccggtacccgaccgggtccctacccggtaccccgttacgtaacccg

SEQ ID NO: 151448 - DNA, 626 bp, Homo sapiens
  misc_feature: GYAE6OF02IVXRD.7.5.A05.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (479)..(479): a, c, t, g, unknown or other
  misc_feature (479)..(479): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcaccatctccngcactggaaccacactgacgttgctggtataaatntctctctgtatcaacaataccaggacaaacgccccaaagctaatctattatgtatgtactaataactcggtccttcgtagggtttacaatcgtcttctctgctaccagttcgtggaccacgtaccgtccctcccgtacgtaccacttccgtccgtagggtccctaccgtacgggctacggtaacgacgacggtactgtactttaattacgtgacacgtctacatacgtaacgngacaacgtcaacgtcctactaccggttaagggtttcccgggacggaccgggtaaccacggttccggtaccggtacccgttaccgttaacggtacccgtacggaccccgtaacgggtccttcccggaccccccggtttcggttacccg

SEQ ID NO: 151449 - DNA, 697 bp, Homo sapiens
  misc_feature: GYAE6OF02IU6ND.7.5.A05.1.454.CMB.1.raw
  modified_base (407)..(407): a, c, t, g, unknown or other
  misc_feature (407)..(407): n is a, c, g, or t
tcagcgtgtctctacacgaccggtgctcgatttagatagatagacaggggggggggtctcaggaggcagcgctctcgggacgtctccaccatggcctgggctctgctattcctcaccctctcactcagggcacagggtcgtgggcccagtctgccctgactcagcctgcctcgtgtctgggtcctctggacagtcgatcaccatcctctgcactcggaacccacctactggacgtttgacttggttaataaaatcttcctctcctggtatacaacaactaccaggacaaacgacccccaaagtctatacctatttaatgtactgtactaatagtcgtccttgtacgggttccaatcgtcttctctcggctaccagtcgtcgacgacaccggcctaccgactaccctntaccgttcgtacgggccctaccggtacggtacgtacgggaacgacggtaggtctaacggttatttaacgttaacgtcggactacgtaccctacaactttacgaaaccggtacgggacctacgaaccgtacggtaccgtacctttacgggttaaccggggtttccggggtaaccgggtaacgggtacccggtaacgtccggttaacccggtaccggtaccggttacggtaccggaacccggtaccggtaaacggtccccggttacccgtccccccgggtagttacccccgg

SEQ ID NO: 151450 - DNA, 636 bp, Homo sapiens
  misc_feature: GYAE6OF02F7XL5.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaacccaccactgacgttgccttaggttaataaaatactctactcctggtatcaaacaactaccagacaaacgccccaaagtcatcatttatgattgtctaataagtcggtccttcgtacggggtttaccaattccgtcttctcgtcgcctacaagttcgtggacgaccgaccggcctcccgcgacctctcctcgtcggcctccgaggtctagaaacggacggaggtctagtactttaacttaccgtgtcgacgtctactaagttaactacgaggccagtcacgtccgacttacggttacgggtttcgggaacgggtaccggaacgaacggtcctaacggtaccccggttaccgtacgggtaccgtaccggacccggttaaccgggcccgttaccccgtacccccggttcggttacccc

SEQ ID NO: 151451 - DNA, 738 bp, Homo sapiens
  misc_feature: GYAE6OF02H8WB0.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcgagggcacgagggtcgtgggcccagtctgccctgactcagcctgcctccgtgtctgggtctctggacagtcgatcacatctctgcactcggaaccacactgacgttgcttggttaataaactatcctactcgtaggtactacaacaactaccgaggacaaaacgcccaaagtacatactattagtcgtatagtactataacgtcgtaccttacgtacgggtttacaagtcgtcttcgtcgtacgtctacgaagtcgtaggacgaacgccgtaccctacctacgaacctcgtccgttacggtccggtccttacccggaggtacctaaacgggtaaacgacggtacggtactttaacggtaactttaaacgttaacctcggtaacgtacgttccgtactaaagttaccgtaacggtaacggccaaaacgtccaacgtaccgtttaccgtaaccgggttttacggggtttaccgggaacggggtaacggtacccgtaaaacggttccgggtaaacccgtaccggggttaaccctttaccgggaaccgttaacccggaaccggtaaacccggggttcccttaaccccggttaccccccggttagttaacccccgg

SEQ ID NO: 151452 - DNA, 561 bp, Homo sapiens
  misc_feature: GYAE6OF02JUIAE.7.5.A05.1.454.CMB.1.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (483)..(483): a, c, t, g, unknown or other
  misc_feature (483)..(483): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttanaaatntctctctgtatcaacataccagcaacnccccaagtccatcatttatgatgtctactatcgccttcagggttcgtaatcgcttctctcgctctagtcgtgcggacaccggtccctccctagaccctactctcgttggcctccgacggacgtcgaagacgaggtcagtattattactcgcgactntaccatacagacgtnaccgtnacgtactccgttactcggggtttaccggngggtacggtacaagggcctcggaaccgtccttacggtccacggtaccctacggccggtccgtccccgttcggtacccg

SEQ ID NO: 151453 - DNA, 797 bp, Homo sapiens
  misc_feature: GYAE6OF02HG5KF.7.5.A05.1.454.CMB.1.raw
  modified_base (248)..(248): a, c, t, g, unknown or other
  misc_feature (248)..(248): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctcctgtatcaacaataccaggcaaacgccccaaagtcatacattactgatgttctataacgtccggtccgttcgtacgggtttccaagtcgtacttctcgtcggccttaccgtaagttcgttcggaccgacccgtaaccgggtcccctttaccccgtacggtaacccctaacgttcccgttccggttccggggttacccgttaccccgtaacggggtaccgttacgggaaacggaaccggtaacggggtcgttaacggtaacgttttaaacgttttaaccggttacgttaccggtaacgttacccttaactaacgtttaaaccgttaaccgtaacgggttaaccgacgggaaccgtaacggtaaccgttaaccgtttaccgggtaaccgggttttttaccggggacccggggttacggggaacccggtaaaccggtccgggttaacccggtaacccgggttacccggttaacgggtacccgacccggttaaccccgggaaacgggcccggttaccccggtaccccccggttccggttaaccccgg

SEQ ID NO: 151454 - DNA, 650 bp, Homo sapiens
  misc_feature: GYAE6OF02JY1Q4.7.5.A05.1.454.CMB.1.raw
  modified_base (250)..(250): a, c, t, g, unknown or other
  misc_feature (250)..(250): n is a, c, g, or t
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (470)..(470): a, c, t, g, unknown or other
  misc_feature (470)..(470): n is a, c, g, or t
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccatcgacgttgcttaggttaataaatntctctcctaggtatacgaacaactaccgagacaacgacccccaaagtcatctaattatacgtntgtactagtaactccggtcttacggtacggggtttacctaagtccgtctttcgtcgtcggtcctacgtaagtcgtcggacgtaccgaccggtccctaccgttacgaaccctntccgttcgtcgggacctccgtacgtcgtacgacggtacgacggtntacgtattacgtactcgacgtacgtcgtactagttaactacgtacggacgtacgagacgtaccttacgtacgttacgggtttccggacgggtacgaaccgtacggtcgtaccggtcgtaccggttacggtaccgtaccggtaccgtaaccggtccgtaccgtccccggtacgtaacccgg

SEQ ID NO: 151455 - DNA, 631 bp, Homo sapiens
  misc_feature: GYAE6OF02I92SZ.7.5.A05.1.454.CMB.1.raw
  modified_base (493)..(493): a, c, t, g, unknown or other
  misc_feature (493)..(493): n is a, c, g, or t
tcagcgtgtctctacacgaccggtgctcgatttagatagatagacagggggggggtcgtcgaggaggcgagcgctctcgggacgtctctaccatggcctgggctctgctattcctcaccctcctcactcagggcacagggtcgtgggcccagtctgcctgactcagcctgcctccgtgtctgggtctccgtggacagtcgatcaccatctcctgcactcggaaccaccaactcggtacgttgcttacggttaataaatactctactcctggtactctaacaactaacctaacggacaaacgacccccaaacgtacctaactacaatttactagtacttgtctaataagtcgtaccttcgtacggttcctaagtctcttctcgtgcctacgaacgtcgtaggccgtacgacgtcctcccgtactacgctcgtctggcctccgtgacgtggtacacgggacgtcgtacgtattaacttcgtagtacgcgtacctntactaactacgacggacacgacgcgacaacgttccgttagggttaccgggtacggtaccgggaacgtacggacgtacggaaccgttcgtacggtaccgacgcccgtaaccggtcgtacccggtccccgtacgtcccgg

SEQ ID NO: 151456 - DNA, 640 bp, Homo sapiens
  misc_feature: GYAE6OF02JI7A0.7.5.A05.1.454.CMB.1.raw
  modified_base (325)..(325): a, c, t, g, unknown or other
  misc_feature (325)..(325): n is a, c, g, or t
  modified_base (465)..(465): a, c, t, g, unknown or other
  misc_feature (465)..(465): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcacagggtcgtcgggcccagtctcgccctgacctcagcctgccctccgtgtcgtcgggtctccgtaggacacgtcgaatccaccatctcctgctacgtacggaacccactactcggacgttcgcttaggttaataaatctcctctcgtagtactacaactaactaccgaagacaaccgaccaatcatactattanagtactacgtactaatacgtcgtacttcgtacggttccaagtccgtactcgtcgacgtactacgtacgtcgcgaccgtacaccgtccctcgacgacctacgcgtcgtacggactcgagtaccgaggaaacggcgtacgtnttaacgtacgttaaacttcgagtaccagtaccgtactaagtacgtacggacgtaccgtagacgtcgtaacgttccgtacgggttacggggtaccgacgggaccggtaacgagtccgtacgtcccggtaacgtccgaaccgacgtcccggagtccccgtccggtacccgtactacg

SEQ ID NO: 151457 - DNA, 638 bp, Homo sapiens
  misc_feature: GYAE6OF02HOFSC.7.5.A05.1.454.CMB.1.raw
  modified_base (208)..(208): a, c, t, g, unknown or other
  misc_feature (208)..(208): n is a, c, g, or t
tcagcgtgtctctacacgaccggtgctcgatttagatagatagacgagggggggggtctcaggaggcagcgctctcggggacgtctccaccatggcctgggctctgctattcctcacccctcctcactcagggcacaggggtcgtgggcccagtctgccctgactcagcctgcctccgtgtctgggtctcctggacagtcgatcaccntcctctgcactggaacccacactgacgttgcttggttaataaatctctctcctggtatacaacaactaccaggacaaacgacccccaaagtcatactaatttatgtatgtactaataactcggtccttacgtagggtttaccaactcgtcttctcgtgcctactaagtcgtaggaccgaccgtaccggtcccttcccgtacgtaccgtacttccgtacggtcggtaccgtccggacggtcgtacggaacggacggtacggtcgttagttatttaagttcgtacgtcgtactcgtaactacgttaactacggtaaggactacgacgacgttacaacgtcggttaacgggttcgggacggacggaacgtacgtcgtaccggtaccgtcgtacggacgtacgcccgaacggcctacccggtcccgtgtacccg

SEQ ID NO: 151458 - DNA, 628 bp, Homo sapiens
  misc_feature: GYAE6OF02G6J0X.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttggttataaatntctctctgtatcaacaactacccaggaccaaacgaccccccaaagtcatcaatttatgatcgtctataactccggtccttacgtacggggtttacctaacgtccgtccgttccctcggtctacctaacgtctcgggcgaccgacggtccctcccgtcgacctacttccgtcgtcgggcctccgacggtcgtaggaacgacggcggtctagtatttacttacgttgtaccgagtctactactaacgtacgagggacgaacgtcgacgcctacgttaccgtaggttttaccgggcgggacgggacgaacggtcggtccggtacccgttccggtacggtccgacgccgaacggtccgtcccggtccccgtccggtctacccg

SEQ ID NO: 151459 - DNA, 725 bp, Homo sapiens
  misc_feature: GYAE6OF02IRX0S.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctgccctgactcagcctgcctccgtgtcgtgggtctcgtggacagtcgatcaccatctcctgcacgtacggaaccaccacgtcgacgttgcgtagttaataaatctctctctgtactcaactaactaccgagaccaaaccgacccctaaagtacactactatttagtagtatgtactaatacgtcggtccttacggtacgggttacaactcgtcttacgtctacgtcctacgtacgtcgtggccgaaccgtaccgtaccctaccctcgtacctacgttaccgttcggtacggtcctaccggcggtacgtacggaaccggtagggacgggtaccgttacggttaactttaacgttacgtcgtaccgtaacgtacctacctaagttaacctacggtaacggacgtaacgaccggtacgtaaccgttaacgttacggtttacgggggtttaccggggaacggggttaaccgggtaccgtaaccgggtcgttaacccgggtaaccggttccgttaacggtaccgtaacccggaccggtaaccggtcccggtcccgtaccccggttcggttaaccccg

SEQ ID NO: 151460 - DNA, 546 bp, Homo sapiens
  misc_feature: GYAE6OF02GQ8LO.7.5.A05.1.454.CMB.1.raw
  modified_base (409)..(409): a, c, t, g, unknown or other
  misc_feature (409)..(409): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccaggcaaagcccccaaagtcatcatttatgatgtctataatcggcttcagggtttccatcgcttctctggctcagtctggcgacacgcctcctgaccatctcgtcgggctcgaggctgaagacgagctagattattacngcagctactatatacgaggacagcagccacgtcgttaggtttcgggacggacgggaccaagggtcctacggtacccggtaccgttacggtccgacggacccgtaacggcccgtaccggtcccccgtcggttaccccg

SEQ ID NO: 151461 - DNA, 833 bp, Homo sapiens
  misc_feature: GYAE6OF02IFDHP.7.5.A05.1.454.CMB.1.raw
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtctgggcccagtctgccctgactcagcctgcctcgtgtctgggtctcctggacagtcgatcaccatcctccngcactggaaccctcactgacgttgcttggttaataaatattcctctctggtatcaaacaatacccaggacaaacgccccaaagtccattctatttangtatgttactataacgtcgtcttacggtacgggtttacctaacgtcgtcttacgtctcgggtacctaccgtaacggttctacgggtcgaaccgtacccggtcccgttaccccgtacgaccctacgtacccgttggtaccgggtccttaccccggagggtaccgtaacggtaaacggtacccggtaagggttaccttttaaacgtttaaccgtttacggttacgtaccgtacggttacccgttacgtaaagttttaaacccggtaacgtaccggggttaacaccgggtaccgtaaacggggtccctttaaaccgggttacccggttttacgggggttttaacccggggggaacccgggggttaacgggtaaccccgttaaacgggttacccgggttaacccggttaaccccggtttacccggtaaacggggtttaccccaaacccggggttaccccggttaaccggttacccccgggttaccccgggtaaccccccgggttttccgggtaacccctttaaccccggg

SEQ ID NO: 151462 - DNA, 591 bp, Homo sapiens
  misc_feature: GYAE6OF02HD72K.7.5.A05.1.454.CMB.1.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (462)..(462): a, c, t, g, unknown or other
  misc_feature (462)..(462): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgaccgttgcttggttaataaatatctctctgtactcaacaactaccagacaaacgccccaaagtcatctattatgtatgtactataatcgcttcgtagggttccaatcgtctctctgctacagtcngcgacacgtcctcctgacctntctcgtcggctccgaggtctaggaacgacggacgtcgtacgtattagttacgtgacgtacgctaccataacgtcgaggtcacgacacncgtaccttacgttacgggttaccgggcgggtaccggaaccgtacggtccgtaacggtacccgttaccggtacggtaccgaacccggtacccgtaaccggtccctacccggtcccccgtaggttaccccg

SEQ ID NO: 151463 - DNA, 656 bp, Homo sapiens
  misc_feature: GYAE6OF02JH93L.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactggacgttgcttggttaataaatntctctcctggtatcaacaactacccaggacaaacgaccccaaagtcactctattatgatgtactaatacgtcgtccttcgtacgggtttaccaactcgtcttctcgtggtcctacctaacgttcgtcggacgaccgaccggtcccttcccgtacgaccctacttcgtccgtcgggtcctccgacgtcgtaaggtaacgacggacggtcgtagtaatttacgtttactgacctacgtctactattaacgtaacgtacggacgtacgaccgaacgaccgtaaccgttcggttacgggtttccgggaaccgggtacgggaaccggacgtccggtaccgtaccggtaccgttacggtaccgacccggaaccgaccggtacccgtccccggtccccgttcggttaccccg

SEQ ID NO: 151464 - DNA, 677 bp, Homo sapiens
  misc_feature: GYAE6OF02JSUQL.7.5.A05.1.454.CMB.1.raw
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
tcagcgtgtctctacacgaccggtgctcgatttagatagatagacagggggggggtctcaggaggcagcgctctcgggacgtctccaccatggcctgggctctgctattcctcaccctctcactcaggcacagggtctgggcccagtctgccctgactcagcctgcctcgtgtctggtctcctggacagtcgatcacatctctgcactggaaccncactgacttgctggtaataaatntcctctctagtactcgaacaactaccaggtacaaacgaccccctaaagtcctactactaactttagtagtactacgttactaacttaacgtcccggtcctttacggttaacgggggtttacctaacgttccgtactttccgtcgtcggtcctaccgtaacgtcgttcggacgtaccgaccggtcctacccgtcgaccctacttccgtacggtcggtaccgtaccgacggtaccgtacggtaacggtacgtaacggtcgttacgttaagttaacgttaccgtacgtaacgaccgttcgttaacgtacggttaaactcggaacgtaccgtacgacgtaccgtactacggtacgttcgggttacgcgggtaccgaacgtacgtaccgcgtacgtaccgtacgtacgtacgaccgtaccggtcgtacccgtccgtccgtaccg

SEQ ID NO: 151465 - DNA, 654 bp, Homo sapiens
  misc_feature: GYAE6OF02IRYZL.7.5.A05.1.454.CMB.1.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (361)..(361): a, c, t, g, unknown or other
  misc_feature (361)..(361): n is a, c, g, or t
  modified_base (416)..(416): a, c, t, g, unknown or other
  misc_feature (416)..(416): n is a, c, g, or t
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgactcaccatctcctgctacctggaacccacccactgaccgttgctacggttataaatatctctctgtancacaactaccagacgaaacncccccaaagtcatactattatacgtatntactattaactcggtaccgtttacgtaggggttaccctaatccgtnttacctgtcggtctcccgtagtaccgtgccgaccacggtcccttcccacgacctntcgtccgtcggacccttccgcggcgtagaacggacgagtcgtacgtatttacttcgtcgactagtacctacagtttacaacgacggacgtacgacgtacgctaacccgttcgttaaccgggtttcgggaccgggaacggtacccgtaacggccgtttaaccggaccggttacccgtacggtaccgtaaccggtaccccggaagggtcccgtaccccggtaccccgttaccggtccccg

SEQ ID NO: 151466 - DNA, 684 bp, Homo sapiens
  misc_feature: GYAE6OF02JIGNF.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgcccctgactcagcctgcctccgtgtctgggtctcctggcagtcgatcacctatctcctgcactacggaaccaccactggtacgttgcgttaggttaataaatctctctacgtgtatacaacaactacccgagaccaaaccgaccccccaaagtcactctaattttagagtattactacgtaacttaacgtccggtccttacggtacggggtttaccaagtcgttcttcgttacgtcggacctacgtaacgtcgtacgggtaccaccgaccgtcccttacccgcgtaaccctactttccggtcgttacgggacccttccggacgtacggtaacggaaacggaccggtaagggactttaggaactttttacgtacgttacgaaccgttacgtactataaacgttaacaccggtaagacgacgttagaacgtactaccgttacggttacgggttacgggacgggtacgaccgacgtcgtacgtacctcggtaccgtacgaccgacggacgccgttacccgcccgtcggtaacc

SEQ ID NO: 151467 - DNA, 658 bp, Homo sapiens
  misc_feature: GYAE6OF02H4SEI.7.5.A05.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgcccctgacctcagcctgcctccgtgtcgtgggtcctcctggacngtcatcaccatcctcctgcactcggaacccaccactgtacgttgcgttggttaataaatntctctctgtatacaacaactaccagacaaacgccccaaagtcatctatttatagatgtactaataagtccgtccttagtacgggtttaccagtctcttctctcggtctcgaacgtcgtacgcgaccgtaccgtccctccgtacaccgtatccgttcgtcgggtcctaccggacggtacgtacggaacgtacgggacgacgtacgttaatttacgttaaccgtgtactactaccgttaactaagttaaccgttaacggacgtaccgaacgaccgtacgtaccgtacgttacggttaacgggttttaccgggacggtaccggtaccgtaacgtccgtacggaccgttccggtaacgtccgacggtaccgtaccggtccgtacccgtcccccgtacgtacccg

SEQ ID NO: 151468 - DNA, 665 bp, Homo sapiens
  misc_feature: GYAE6OF02HGBNS.7.5.A05.1.454.CMB.1.raw
  modified_base (312)..(312): a, c, t, g, unknown or other
  misc_feature (312)..(312): n is a, c, g, or t
tcagcgtgtctctacacgaccggtgctcgatttagatagatagacgagggggggggtctcaggaggcagcgctctcgggacgtctccaccatggcctgggctctgctattcctcaccctctcactcaggcacgagggtcgtgggcccagtctgccctgactcagcctgcctccgtgtctgggtcctcccggacagtcgatcaccatctcctgcactcggaacccacactgacgttgcttaggttaataaaatctctctcctggtactacaaacaactaccaggacaaacgaccccaaagtcatactatttangatcgtactataacgtccggtccttacgtacgggtttaccaagttccgtctttctcgtcgtacctaccaagtcgtcggacgacctaccggccctcccgtacgacctattccgtcgtcgggtcctccgacggtactacggaacgtacggcgtacgtagtactttaacgttacgtacgtacgtacgtacctactaattactaacgacggtacacgaccgacgaccgtacgttaccggttacggtttccgggaccgggtaacggaccgtaacggtccgtaccggaccggttcgtacggtaccgaccggacccgtacggtcccgtacccggtaccccggttcgtacccgttaacccg

SEQ ID NO: 151469 - DNA, 714 bp, Homo sapiens
  misc_feature: GYAE6OF02JM95F.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacttgctggttaataaatatctctctgtatcaacactaccgagacaaacgccccaaagtcactctattatagtatcgtactactacgtccggtccttacgtacgggtttacctaagtccgtaccttcgtcgtcgggtaccttaccgaacgttcgtacggacgtaccgtacccggtacccttcccgtacgaccctacttaccgttccggtacgggtcccgttacccgagggttccgtaacggtaaacggacggtaagggtccttacgtaaagtttacttaaccggtgtaccgacgtactccgtaatttaaccgaccggtaacggaccgacgtaccgtaacggtacctaccgttacggtttacgggggtttccgggaccgggtacgggtaaccgtaacggtcccgttaaccggttacccggttaaccttacgggacctaccgggaacccgtaccggtcccgtccccggtaccccgttccgggtacccg

SEQ ID NO: 151470 - DNA, 566 bp, Homo sapiens
  misc_feature: GYAE6OF02GEL3O.7.5.A05.1.454.CMB.1.raw
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggacaaagcccccaaagtcatcatttatgatgtactataatcggccttcgtagggtttccaagtcgtcttctctggctacaagtctggcacaccggtcctccctgacctactctctgggcctccgaggctgaaaggacgaggctagattattactgacagctnatanacaggcagcagccacgtcgtagggtttaccgggcgggacgggaccaaggtccgtacggtaccccgtccgttaacggtccgaacggacccgtaacgggcccgtaccggtccccccgtaggttaccccg

SEQ ID NO: 151471 - DNA, 589 bp, Homo sapiens
  misc_feature: GYAE6OF02FYS21.7.5.A05.1.454.CMB.1.raw
  modified_base (252)..(252): a, c, t, g, unknown or other
  misc_feature (252)..(252): n is a, c, g, or t
  modified_base (439)..(439): a, c, t, g, unknown or other
  misc_feature (439)..(439): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacaggggtcgtgggcccagtctgccctgactcagcctgcctccgtgtctgggtctcctggacagtcgatcaccatctcctgcactggaacccaccactgacgttgcttggttaataaatntctctcctggtatcaaacaactacccaggacaaacgacccccaaagtcataccatttatgattgtactataatcggaccttcgaggggtttaccattcgtcttctctggcctcaagtctggcgacacggcctcctcgacctatctcgtcggcctcgaggcgtagaagacgagctatatttattacgngctacgctactattaatacgagcagacgacgactacgtcgttaggggtttccggagggacggtacccgaaggtccgttacggtacccggttccgtaacggtccgtaccggaccgtaacggtcccgtcccggtcccccgtacggtaccccg

SEQ ID NO: 151472 - DNA, 556 bp, Homo sapiens
  misc_feature: GYAE6OF02IX6XN.7.5.A05.1.454.CMB.1.raw
  modified_base (245)..(245): a, c, t, g, unknown or other
  misc_feature (245)..(245): n is a, c, g, or t
tcagcgtgtctctacacgaccggtgctcgatttagatagatagacagggggggggtctcaggaggcagcgctctcgggacgtctccacatggcctgggctctgctattcctcaccctctcactcagggcacagggtcgtgggcccagtctgccctgactcagcctgcctccgtgtctgggtctcctggacagtcgatcaccatctctgcactggaaccacacgtgacgttgctggttaataaatntctctctgtatcaacaactaccagacaaacgccccaagtcatcatttatgtatgtactatatcgcttcgtagggtttcatcgtcttctctgctcagtctgcacgacggtcctccgtcactactcgtcgtcggtcctaccgacggtcgtaggaacgagtacggtacgttagtattacgtttacgtcgtacagtctctatacacgacgacagcaacgctacgtcgttagggttcgacggtacggactaacggtcgtacgtaccggtacgtacggtactacggaccgtaacgccgtccgtccccgtcgtacccg

SEQ ID NO: 151473 - DNA, 791 bp, Homo sapiens
  misc_feature: GYAE6OF02HU83W.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttaggttaataaatatctctcctgtatcaacaataccgagacaaacgacccccaaagtcatactaatttatgtatagtcctaataacgtcggtcctttacgtacggggtttacctaacttcgtcctttctaccgtgtacctaccgtaacgtcgttggaccgaaccggaacccggtcccgtccctacggtaccctaacgttcctaccgttcgggtaccgtcccggaacggtcctaaggaaacggtaaacggaacgggtacgtacggttaaactttaagttaccgttacggactaccgtacgttactaaacttaacgttaaccggtaacgggtaccgaaacgaccggtaacgttacccggttaacccgttaacgggtttaaccgggggtttttaccgggggaacccgggggaaccgggggtaaccctaaacggggtacccggttaccgggtaacccgggtttacccggttaaccggggttacccgaaccccgggtacccgggtaaaaccggtttccccgggtaccccggtaccccccggtttaccgggttaacccccg

SEQ ID NO: 151474 - DNA, 653 bp, Homo sapiens
  misc_feature: GYAE6OF02GPKRF.7.5.A05.1.454.CMB.1.raw
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
tcagcgtgtctctacacgaccggtgctcgatttagatagatagacaggggggggggtctcaggaggcagcgctctcgggacgtctccaccatggcctgggctctgctattcctcacccctcctcactcagggcacagggtcgtgggcccagtctgccctgactcagcctgcctccgtgtctgggtctccgtggacagtcgatcaccatctctgcactggaaccaccactgacgttgctaggttaataaatntctctctgtatcaacaactaccagacaaacgccccaaagtcatctaattntgatgtactataactcggtccttcggacgggtttccaacgtcgtctttcctcgtcggtctttacgacgtcgttggaccgaccgtacccgggtccctcccgtacgacctactcctacggtcgggtaccctccgacggtacgtaggaacggacggtacggtaccgtcgtaaagtttactttacgtacgtcgtacgtctaactaacgttaataccgaacggacacgacacgtacaccgttacggttacgggtttccggggacgggaccggtaacgtacggaccggtcggtacccgttaccggtacgtaccgcggtacccgaccggtcccgtaccggtaccccccgtggtaccccg

SEQ ID NO: 151475 - DNA, 588 bp, Homo sapiens
  misc_feature: GYAE6OF02JKL1D.7.5.A05.1.454.CMB.1.raw
  modified_base (120)..(120): a, c, t, g, unknown or other
  misc_feature (120)..(120): n is a, c, g, or t
  modified_base (181)..(181): a, c, t, g, unknown or other
  misc_feature (181)..(181): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
tcagcgtgtctctacacgaccggtgctcgatttagatagatagacagggggggggtctcaggaggcagcgctctcgggacgtctccacatggcctgggctctgctattcctcacctcctnactcagggcacaggtcgtggcccagtctgccctgactcagcctgcctcgtgtactgggtcncctggacagtcgatcaccatctctgcacgtgaaccncatgactgctgtaanaatctctctctgtactcaacgactacccgaggacaaacgtaccccaaagtccatctattactgaatcgtctagtaactcggtacttcggtacggttccatccgcttctctgtcctacgacttcgtgacgacgtacgccgtcctacgtactattctcggtggtccctacgtacggtcgtagaacggacgtacgtccttaggtactttactacgtcgaactcgtacatacgtactacgacgtcgacggtacacgtactaccgtggttaacgggtcgggtaagtaccggacgtacgtccggtacgtacgtccgtaaggccttacggaccgtaccggtccgtaccttcccgacggttacc

SEQ ID NO: 151476 - DNA, 758 bp, Homo sapiens
  misc_feature: GYAE6OF02I8BO7.7.5.A05.1.454.CMB.1.raw
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (467)..(467): a, c, t, g, unknown or other
  misc_feature (467)..(467): n is a, c, g, or t
tcagcgtgtctctacacgaccggtgctcgatttagatagatagacagggggggggtctcaggaggcagcgctctcgggacgtctccaccatggcctgggctctgctattcctcaccctctcactcgaggcacagggtcgtgggcccagtctgccctgactcagcctgcctcgtgtctgggtctccgtggacaggtcatccaacntccncgtgacacgtaggacccactactcggtactcgcttcggttaaataaacgtctcctcttaccctggtacttaccaaacaacttaccgacggtaccaaacgtccccctaaaaagtctacgtactactttagtcgaacgttgtactagtaagttaccgtccgttacgttacgggttaccaacgttccgtcttccgtcgttacgaccgttacgtaacgttccgttgaccgtaccgtccggtacccttcccgtacggtaacccngtttacccgtccggttacgtccgtaccggacgtccggtaagtaaccgggtacgacggtcttaacggttatttaaaccgttcgacctaacggtcgtacctacgtaccgtttaacgacgttacggaccgtaagccgttacgtaccgtaccggtttacgttccgggttacgggtaccggtaaccggtaccgtaccggtaccggttaacccttacgggttacccttaacgggtccctaacccgggtaacccgtacggttccccgttaccccggtacccgttaccggttaaccccg

SEQ ID NO: 151477 - DNA, 580 bp, Homo sapiens
  misc_feature: GYAE6OF02G8O02.7.5.A05.1.454.CMB.1.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactcggaaccaccactgacgttgctggttaataaatntctctcctggtatcaacaactaccagacaaacgacccccaaagtcatctatttangatgtctatatcggtccttcgtagggttccaatcgtcttcttctcgctcaagttcgtggacgacacggtccctccctcgacctactctcgtcggcctccgaggtctacggaagaacggaggtcgtaagtattaacgttacgtcgacagctactaatactacgacgtcgagacgacacgtcgttcgtacggggtttcggacgggtacggaccgtaggtcgtacggtccgtaccgtacggtcaccgaccgaacgtccgtccgtccccgtcggtacccg

SEQ ID NO: 151478 - DNA, 664 bp, Homo sapiens
  misc_feature: GYAE6OF02FNLCT.7.5.A05.1.454.CMB.1.raw
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
tcagcgtgtctctacacgaccggtgctcgatttagatagatagacgagggggggggtctcaggaggcagcgctctcgggacgtctccaccatggcctgggctctgctacttccctcaccctcctcactcagggcacagggtcgtggcccagtctcgccctgactcagcctgcctccgtgtctgggtctcctggacagtcatcaccatcctcctgccactggaaccaccactgacgttgctggttataaatntctctctggtatcaacaactaccaggcaaacgcccccaaagtcatcatttangtntntactaataacgtcgcttacgtagggtttaccaagttcgtcttctcgtcggtacctcctaagtcgtacggccgaacgaccggtccctacccgtcgacctactctcgtacggtctccgtagtcgtacggtaacgaccggaggtcgttagtaagtttacttacgtcgtaccgacgtacgtactaactacgttaacgacggacgtagtaccgtaagtaccctaacgttacggttacggggttttccgggacgggtaccgggtaaccggaacggtccgtaaccggtaccccgtaccggttacggtaccgtaccggacccggtacgtcccggtaccccggttacccccgttccggttacccg

SEQ ID NO: 151479 - DNA, 726 bp, Homo sapiens
  misc_feature: GYAE6OF02IQERC.7.5.A05.1.454.CMB.1.raw
tcagcgtgtctctacacgaccggtgctcgatttagatagatagacagggggggggtcgtcgaggaggcagcgctctcgggacgtctccaccatgcctgggctctgctattcctcaccctcctcactcaggcacagggtcgtgggcccagtctgccctgactcagcctgcctccgtgtctgggtctcctggactagtcgatcaccatcctcctgccatcggaacccaccactgtacgttcgcgttacggttaataaattactcttcctccgttaggttactactaaacctaaacgttaaccccgaacggtaccgaaaaaccgaacccccccgtaaaaggtacctaaactaccttaattttaactacggtattacgttaacttaattaacgtaccgtcccgtttacggttaacggggtttacccttaacgtcgtccgttttacctcgttcggcctttaccaacggttcggttcggacgtaaccgacccggtccctaccccgtacgacctactcgttcgtcggtccttccgagtcgtagaagtacggagtcaggttaattaactttcgcgtacaccgtactacctaatacttaacggacggtacgaacgtcgtacgactacccggttagtaccgggttttacgggacgggttaccgaaccggtacgtcccgtagtacccgtacggtacgacgacggtacccgagtccgtaccgtccccgtacgttcccg

SEQ ID NO: 151480 - DNA, 696 bp, Homo sapiens
  misc_feature: GYAE6OF02G1SAI.7.5.A05.1.454.CMB.1.raw
  modified_base (204)..(204): a, c, t, g, unknown or other
  misc_feature (204)..(204): n is a, c, g, or t
  modified_base (563)..(563): a, c, t, g, unknown or other
  misc_feature (563)..(563): n is a, c, g, or t
  modified_base (685)..(685): a, c, t, g, unknown or other
  misc_feature (685)..(685): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcatcaccntcctcctgccacgtacggaacccaccacgtgacgttgcttaggttaataaatactcctctccgtggtactacaaacaacttacccgaaggaccaaaaccgtcccccaaagtctaactctaatttacgtgagttcgtacttaataacgtccggtacctttacggtacggggtttaccaacgttccgttccttaccgtcgttacggacccttacgaacgttcgtacggaccgtaaccgtccggtacccctacccgacggtacctacttccgttcggtcggtcctaccggaggtacctaggaaacgtcggacgtcttagacttacgtaccgatacgtactactagtactacggacgtccgancgaacgtcctacgttcgggttacggttaccggggcgggttaacggaccgtaggtccgtaccggtaccgttaccgtggtaaccgacccgtaccggacggttccctacccggtcccccggttanacccgttccgg

SEQ ID NO: 151481 - DNA, 759 bp, Homo sapiens
  misc_feature: GYAE6OF02I91XS.7.5.A05.1.454.CMB.1.raw
  modified_base (378)..(378): a, c, t, g, unknown or other
  misc_feature (378)..(378): n is a, c, g, or t
  modified_base (752)..(752): a, c, t, g, unknown or other
  misc_feature (752)..(752): n is a, c, g, or t
tcagcgtgtctctacacgaccggtgctcgatttagatagatagacgaggggggggtctcaggaggcagcgctctcgggacgtctccacatggcctgggctctgctattcctcaccctcctcactcagggcacgtagggtccgtgggcccaggtcctggccctgacctcacggcctcgcctccggtgttccgtcgggtctccgtaggaccaacgtcgtacgtcaccgatccgtctgcacgtaccggaccaccactacggtaccgttgccgttagggtttacaaaacgttacttcctccgttccgtaggtacttaaccaaccgaaacttaacccgacggtaccaaaaccgcccccgtaaaaggtcaacgttcacgtttancgtatgtacctactaaacgtccgggttaccttacggttacgggttttaccgaacgttcccgtacgtttccgtaacgttcgggtaccttacccgtaacggttcctagggacccggtaccgtaaccgggtccccttcccgtacgtaccgtactttccgtaccggttccgggactccggtaaacgggtcttaaacggaaccgggtaaacggacggttacctagtactttattacccgttggaccaacgtcgtaacagttaacgtcgaggtaccacgtacacggttacaccggtacgttacggggtttaccgggacggacgggtctaccggacgtcctacccgtgtacgacgtacgccgacgtccggacccgtcccgngtacccg

SEQ ID NO: 151482 - DNA, 914 bp, Homo sapiens
  misc_feature: GYAE6OF02JI5M5.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgccctgactcagcctgcctccgtgtcgtgggtctccgtggacagtcgatcaccatcctcctgcactcggaaacccacctacgtcggtacgttgcgttaggttaaactaaatcttcctacttccgtggttaactaccaaacaacgttacccgacggaccaaaccgacccccaaagtcctacgttactaatttacagtagttacgtacttaataacgtccggttaccgtttacggttaacgggtttccctaacgttccgtcgtttctcgttcggaccttaccgtaacgttcgtacgggtaccgaaccgtacccgggtcccttaccccgtagtaacccgtcttcccgttaccggtccggggttaccctacccgggtaacgggtacccggtaacggtaaaacggggtacccgggtaacgggttaccgttaaacggtttaacgttttaaaccgggtttacccgttacgggaacccttaaccgggttccctttaaaccggttaaacgtttaacggaacccgggtaacggtaccgtaaccgggaaccgtaccgggttaacccgttaccggttttaaacggggtttacccggggggttttaccgggaaaccgggggttaccccggggaaaacccttacgggggtccccgtttaaaccgggtacccggtttacccgggtaaacccgggtttccgaaaccccgggtaacccggttaacccgggttaccccggttaccccgggttaccccccgggttacggttaacccccgg

SEQ ID NO: 151483 - DNA, 717 bp, Homo sapiens
  misc_feature: GYAE6OF02GOTN3.7.5.A05.1.454.CMB.1.raw
  modified_base (168)..(168): a, c, t, g, unknown or other
  misc_feature (168)..(168): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
tcagcgtgtctctacacgaccggtgctcgatttagatagatagacaggggggggggtctcaggaggcagcgctctcgggacgtctccaccatggcctcgggctctgctattcctcgaccctcctcgactccagggcacagggtcgtgggcccagtctgccctgactcngcctgcctccgtgtctgggtctcctggacagtcgatcaccntctcctgcactcggaaccacnctgacgttgctggttaactaaatctctctctgtatacaacaactaccaggcaaaacgtccccaaagtcatactatttacngtatcgtactaataacgttcggtccttacgtacggggtttacccaattccgtcttccttcgtacggtctacctaacggttccgtgggaaccgacgtacccgccctttccccgtacgacctacttccgttacggtcggtaccctaccggacgggtaccgtaagggtaaaccggaccgggtacgggtacttacggtaacgtttaaccgttactacggtctaaaccggtcctaccgtaataccgaggtaaccggtacgacgtacgacgaccttaacgtcgttacggtttacccggggacgggtacggtacccgaacgttccggaaccggttaccccggttacggtaaccgtaccggtaacccggtaccggtaacccgtacccgtccccggtacccccgttcgttaccccg

SEQ ID NO: 151484 - DNA, 583 bp, Homo sapiens
  misc_feature: GYAE6OF02GPM9G.7.5.A05.1.454.CMB.1.raw
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (473)..(473): a, c, t, g, unknown or other
  misc_feature (473)..(473): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggacccagtctgccctgactcagcctgcctccgtgtctgggtctcctggacagtcgatcaccatcctctgcactcggaaccacactgacgttgctggttaataaatattcctctcctggtactacaacaactaccaggtacaaacggaccccaaagtcaatctaatttatgattgtactataacgtccggtcttacgtagggtttccaagtcgtactctntcgctacaacgtcgtgacgacncgtcctcctgaccatctacgtcggctccgaggtacaggaagcgaggtctaagtattactcgtgacatctacagtaactcgaaggcacgntacgtctacgttcggttacgggttaccggacgggacgtaacccaggtcgtaccgtaccgtcgttaacggtccacggaccgtagccccgttccgtacccgtcggtaacccg

SEQ ID NO: 151485 - DNA, 772 bp, Homo sapiens
  misc_feature: GYAE6OF02GIM59.7.5.A05.1.454.CMB.1.raw
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcaccatctcctgcacgtcggaaccaccactcgtacgttgcttggttaataaatatctctcctgtactacaacaactaccgaggaccaaccgaccccaaagtcactactatttatgtatacgttactaataacgtccggtccttacggtacgggtttaccaacgttccttacttccttcgtcgtaccttaccgtaacggttccgttacggaccgtaacccgtacccgggtccccttaccccgttaccgtaaccctaccgttccgttccggtccgggtccctacccggaacgggtcccgttaaacggaaacgggtaaccggtaacggtaccgttaggttaacttttaacgtttaaccgtacggtactaaccgttccttaactaaacgttacgtaaccggagggacacgggtaccaaccgttaccgaaccggtttacggttaacggggtttaccgggaccggggttaaccgggaccgtaacgggtccgttaacccgggttacccgttaaccggtacggtaccgtacccggacccgtaaccggttcccggtaccccggtccccggttacgtaacccg

SEQ ID NO: 151486 - DNA, 633 bp, Homo sapiens
  misc_feature: GYAE6OF02JQPJ7.7.5.A05.1.454.CMB.1.raw
  modified_base (175)..(175): a, c, t, g, unknown or other
  misc_feature (175)..(175): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
tcagcgtgtctctacacgaccggtgctcgatttagatagatagacaggggggggtcgtcgaggaggcagcgctctcgggacgtctccaccatggcctgggctctgctattcctcaccctcctcactcaggcacagggtcgtggcccagtctgccctgactcagcctgcctccgtntcgtggtctccgtggacagtcgatcaccatctcctgcacgtcggaaccncactgacgttncctggttaataaatntctctcctgtatcaacaactaccagacaacgacccccaagtccaatctattatgtatcgtctaataacgtcgtaccgttcgtacgggtttacctaacgtctctttccgtacttggtcctacgtaacgttctacggaccgtaccgaccggtaccctcccttccgaaactccgtctaccggtcgggtacccttccgtacgggttacgtacggtaaaccgacgggtacgtaccgttcgtaaagtttacctttcgaaccgtcacgtcgtactactagttaacgcgactgactagcctactacggttagtcggtacggaggtaaccacggtcgacgtacccgtcgtacgacgtaccggaccgtaagcccggtccgacccgtcggtacc

SEQ ID NO: 151487 - DNA, 638 bp, Homo sapiens
  misc_feature: GYAE6OF02GJTEQ.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctctcgggacgtctccaccagtggcctgggctctgctattcctcaccctcctcactcagggcacagggtcgtgggcccagtctgccctgactcagcctgcctcgtgtctgggtcctcctggacagtcgatcaccatctcctgcactggaaccacactgacgttgcttggttataaatntctctacctgtatcaacaataccaggacaaacgacccccaaagtcatactatttatgtatgtactataactccgtccttacgtacggggtttccaagtcgtactttcgtcgtcggtctacctaaggtcctaggacgaaccgtaccgggtcccttaccctacgaacctactaccttcgtcgggaccgtccgaggtcgtacggaaacggaccggacggtcgtagtaacgtttacttacgtcgcacgcctacgataactaacgacggtcacgacacgcctaacttacgtaggtttaccgggacggtacggacgaacgtcgtacgacccggttccgtaacggtaccgtacggacccgtaacggtccctacccggtaccccgttcggtaacccg

SEQ ID NO: 151488 - DNA, 665 bp, Homo sapiens
  misc_feature: GYAE6OF02JQK5X.7.5.A05.1.454.CMB.1.raw
  modified_base (219)..(219): a, c, t, g, unknown or other
  misc_feature (219)..(219): n is a, c, g, or t
tcagcgtgtctctacacgaccggtgctcgatttagatagatagacagggggggggtcgtcgaggaggcagcgctctcgggacgtctccaccatggcctgggctctgctattctcacctcctcactcagggcacagggtcgtgggcccagtctgcctgactcagcctgcctccgtgtctgggtctctggacagtcgactcaccatctctgcactgaaccncactgacgtgctgtaataatatctctctagtatacacaactaccagcaacacccaatcatactattactaggtactcgtactaagttaatccgtaccgtttacgtacgggttactaacgttcgtctttctcgttcggcttacccgaaggttcttacgggacgtaaccggtaccggaccccttcccgtacgtaccctacgttccgttccggtacggtcccgttcccgaacgggtcttacggaaacgggtaacgacggttaccgtaaggttaccttttaacgttaccttcgacgttacgccttaagtaccttaagaacgttacggcgtaaaccgtcaaccgtcgtacctacgggtttacggtttaccgggacgggtacggaaacgtccggagttccgtaacgggtcgttacggcaccggcgaaccgcgtacccgtcccgtaccgtacg

SEQ ID NO: 151489 - DNA, 644 bp, Homo sapiens
  misc_feature: GYAE6OF02F2IQP.7.5.A05.1.454.CMB.1.raw
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgccactggaacccaccactgacgttgcttggttaataaatactctctctggtatcaacaactacccaggacaaacgcccccaagtcatctatttatgattgactaataagtcggccttacgtacggggtttaccaagttcgtctttcctcgtcggtcctaccgaagttcgtcgggaccgacgaccggtccctccccgtacacctactctcgtcgggcccttccgaggtctaggaacgacggnggtactagtatttagttacngacagctacagttaacacgacggacacgtactacgaccgtaacttcggttacgggtttacgggaccgggtacggggtaaccaacggttcccggaccggttaacccgtaccggttacggtaccgaccgtcccggaacggtcccgtccccggtaccccccgtggttaacccccg

SEQ ID NO: 151490 - DNA, 623 bp, Homo sapiens
  misc_feature: GYAE6OF02FKU0L.7.5.A05.1.454.CMB.1.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaacaatacccaggcaaacgcccccaaagtccatcatttangatgtactatactcgccttcgtagggtttccaatcgcttctcgtgctcagtctcggcgacacgtcctccctgaccatctcgtcgggcctcgaggctaggaaagacgcggtctagtaatttagttactgtcagtctactaattactaacgacggtacgacgacgaacgtctaaccgttacggttacggggttttaccgggacggggacgggtaaccgtaacgggtacccgtaccggtaacccggttacccggtaacgggtcccgtaacggtacccggaaacgggttcccgtaccccggttacccccgttaccggttaaccccg

SEQ ID NO: 151491 - DNA, 715 bp, Homo sapiens
  misc_feature: GYAE6OF02JMUN5.7.5.A05.1.454.CMB.1.raw
  modified_base (132)..(132): a, c, t, g, unknown or other
  misc_feature (132)..(132): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
tcagcgtgtctctacacgaccggtgctcgatttagatagatagacaggggggggtcgtcaggaggcagcgctctcgggacgtctccaccatggcctggctctgctattcctcaccctcctcactcaggcacngggtcgtgggcccagtctgccctgactcagcctgcctccgtgtctgggtctccgtggacagtcgatcaccatctcctgacactggaacccacactgacgttgcttaggttanaatatctctcngcatcaacaactaccagacaaacgaccccaaagtcatcatttangtatgtactaataatcgtccttcgtacgggtttaccaagtctccttaccgtcgttcggtacctacccgtaagtttcccgtcgggaccgtaacccgtacccggtaccccgttccccgaaccgtacccgtacttacccgttcggtcccggggtactaccccggtacgggtaccgtacggtaaacgggaccggtaacggtacgtaacggttaacttttaacgtttaccgtaaggtccaacggttacctaccgttaataacgtaaccgtacggacccgaagtaccgaccgtacgtaccggttcgttaccggggtttcggaccgggtaacggaaccgtaacgaccgttacggtacccgttacccggttaggtacccgaccggtacccgtaacggtcccctccccggtaccccggtacccgg

SEQ ID NO: 151492 - DNA, 607 bp, Homo sapiens
  misc_feature: GYAE6OF02HIB22.7.5.A05.1.454.CMB.1.raw
  modified_base (564)..(564): a, c, t, g, unknown or other
  misc_feature (564)..(564): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttataatatctctcctgtatcaacaatacccaggacaaacgaccccaaagtcatctaatttatgatgtctataagtcgtccttacgacgggtttccaattccgtacttcgtctggctaccgtaagtcgttggacgactaccgggcccttccctggaccctagttcctaccgtcggtcctccgtacgggtctacggaacggacggacggtacgtggttaaatttacgttaacgttacgtacgtacgtctactaacgtaacgtaaccgtaggaccgtacgtacacgtacctacgtcgtacgggtttcggacgggtacggacgacggtcncgtaccgtcgtcgtacgcgaccgagccgtccgtcccgtgtccg

SEQ ID NO: 151493 - DNA, 677 bp, Homo sapiens
  misc_feature: GYAE6OF02IZ98K.7.5.A05.1.454.CMB.1.raw
tcagcgtgtctctacacgaccggtgctcgatttagatagatagacaggggggggggtctcaggaggcagcgctctcgggacgtctccaccatggcctgggctctgctaattcctcaccctcctcactcagggcacagggtcgtgggcccagtctgccctgactcagcctgcctcgtgtctgggtctcctggacagtcgatcaccatctcctgcacgtggaacccacactcggacgttgcctggttaaactaatatcctctccgtgtatacaactaactaccgaggaccaaacgacccccaaagtcactactaatttactggtatcgtactaataacgtcggtaccttgtacggggtttaccaacgtcttcctttctacgttcggtctaccgacgttccgtggacgaaccgtacggcccttacccgtacggaaccctcgtttaccgtcgttacgggtacccgtaccgtaagggtacctacggaacggaaccgggtcgggtaaccttacggttaagttttaacttaccgtggacgttaacctcgtacaactttaacgaccaagtccgagtcgagccctagttccggttaacgggtttccggacggtacggacgacgtcgtaccggaccgtacgtaccgtcgaccgtccgacggtacctaccggtccccgtacgtacccg

SEQ ID NO: 151494 - DNA, 561 bp, Homo sapiens
  misc_feature: GYAE6OF02IKS1I.7.5.A05.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagcgtgtctctacacgaccggtgctcgatttagatagatagacgaggggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccncactgacgttgctggttaanaaatatctctcctggtatacaacaatacccaggcaaaacgcccccaaagtctaatcactttatgtatgtctataatcgccttnagggtttcatcgcttntctgctcaagtctgcgacncggcctccctgacctatcctcgtcgggctccaggcgtgaagcgacgcgtgtaatttacttactggacagtctacatactaacagtcacgcacgcactcgtagttttcggacgtacgggaccgaaggtcctacggccggtaccgttacggaccgtacggacccgtaacggtaccgtcccggtacccccgtcggttacccg

SEQ ID NO: 151495 - DNA, 649 bp, Homo sapiens
  misc_feature: GYAE6OF02F9HOI.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgctggttaataaatatctctcctggtatcaaacaactacccaggacaaacgcccccaaagtcatacatttatgatgtctaataagtcgtccttcgtagggtttaccaatcgtcttctcgtggtcctccgtaagtcgtggacgaccgaccggtccctcccgtacgaccctacttctccgtcgggcctaccgaggcgtaggaacgacggacggtcttagaactttagttacgtgtcgacgtcctactaattactaacggacggtaccagaccgacgcctaacgttaccggttaaggggtttacccgggacgggtacggggtaacccgtaaggtccgtaccggtacccggttaccgtaacgggtacccgaacggaccccgtaacgggcccgtcccggtacccccccgtggtaccccg

SEQ ID NO: 151496 - DNA, 599 bp, Homo sapiens
  misc_feature: GYAE6OF02FJ65R.7.5.A05.1.454.CMB.1.raw
  modified_base (167)..(167): a, c, t, g, unknown or other
  misc_feature (167)..(167): n is a, c, g, or t
  modified_base (267)..(267): a, c, t, g, unknown or other
  misc_feature (267)..(267): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagcgtgtctctacacgaccggtgctcgatttagatagatagacagggggggggggtctcaggaggcagcgctctcgggacgtctccaccatggcctgggctctgctattcctcaccctcctcactcaggggcacaggggtcgtgggcccagtctgccctgactcngcctgcctccgtgtctgggtctcctggacagtcgatcaccatctcctgcactcggaaccaccactgacgttgctgttaataaatatctctctgtatcaanaactacccagacaaacgccccaaagtcatcattatgatgtctataagtcgtccttcgtagggttccaatcgtnttctctgctcagtcnggcacncgcctccngacctactcgtcgtcggtctccaggtcctaggacgaccggaggtcctagtactttacgttactcggtacacgtctactacgtaactacggacggctacggacacgccgtacttacggttaccgggtttccggggaaccgggtacgggaacccgaaggtccgtaccgtaccggttacccgtaggttaccgacgtacccggaaggtacccgtccgacccccgttcgtacccg

SEQ ID NO: 151497 - DNA, 671 bp, Homo sapiens
  misc_feature: GYAE6OF02G3HK4.7.5.A05.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
tcagcgtgtctctacacgaccggtgctcgatttagatagatagacagggggggggtcgtcgaggaggcagcgctctcgggacgtctccaccatggcctgggctctgctattcctcaccctcctcactcagggcacagggtcgtcgggcccagtctcgccctgactcagcctgcctcgtgtctgggtctcctggacagtcgatcaccatcncctgcactggaacccncactgacgttgctggttaataaatntcttcnccgttggtatcaaacaatacccgaggcaaaacgcccctaaagtcatcactttangattagtactaataatccggtaccttacggtacggggtttacctaaattccggtctttccgtctcggtcctcgaacgttctcggtaccggaactacccgggtccctacccgtcgacccgtatccgtagtcgggtcctccgagtctaaggaacgtacgacgggtacgtggtaactttagttaacgtacgtacacgtcctacattaacacgtagtaccgaagtcaactacgacctacggttacgggtttacgggccggtaacggggaacctaacggtaccgtaccggtaacccgtaccggttaccgggtaccgacggttacccgaacgggtccggtcccggttaccccgtaccccgggtacc

SEQ ID NO: 151498 - DNA, 648 bp, Homo sapiens
  misc_feature: GYAE6OF02IIQ5D.7.5.A05.1.454.CMB.1.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
tcagcgtgtctctacacgaccggtgctcgatttagatagatagacagggggggggtcgtcaggaggcagcgctctcgggacgtctccaccatggcctgggctctgctattcctcaccctcctcactcaggcacagggtcttgggcccagtctgccctgactcagccctgccctcgtgtcgtgggtctccgtggacagtcgatcaccatctcctgcactcggaaccaccactgacggttncgttggttaataaatntctctcctgtatcaacaactaccagcaaacgcccccaaagtcatcattatgatgtctataatacggtccttcgagggttttccaatcgtcttctctggcctccaagtctggccgacacggcccgtaccctcgaccctagttctcgtcgggtcctacccgtaggccgtgtaaacgaacggacggtacgttcgtagtttaacttaactcgtacgaccggacttccgtataaacgttacgtaacggaccgtaaaggccaacggtccaccgttaccggtaacgggtttttcgggacggggtacgggaaccggtaacggtacgttccggtaaccggttcccgtacgggttaccgacggtaacccgtaacggcccgtacgtacccccgtccggttcccg

SEQ ID NO: 151499 - DNA, 791 bp, Homo sapiens
  misc_feature: GYAE6OF02H76EK.7.5.A05.1.454.CMB.1.raw
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctcctggacagtcgatcacatctctcgcactacggaacccacctactcgtaacgttgtacttaggttaaataaattacttccttcttaccgttaggttaactacaaactaaactacccgaaggtaccaaaccgacccccaaaagtacaactacctaattttatagtatcgttaactaacttaactccggttacctttacgggtaacgggtttaccaattccggttccttcgttacgtcggtactaccgtagtacgtcggtacgaaccgtacccggtccctcccggtacgaccctacttaccgtcgtcgggaccctaccgggtacgtaccggaagggtaaacgacggtacggtacctttaaggtaactttaaccgttacgtacgtaccgtaagtaccttaacgtaacttaacggaaaccgtaacggcgtaaccgcggaaccgtaccgttaaccggttacgggttaaccgggtttacggggaaccgggtaaccgggtaacccgacggtcggttaacccgggttacccgtaaccgggttaccgttaaccggacccgtaacccgggaacgtcccccgtttaacccggtcccccggttacgttaccccgg

SEQ ID NO: 151500 - DNA, 582 bp, Homo sapiens
  misc_feature: GYAE6OF02GV78Y.7.5.A05.1.454.CMB.1.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgccctccgtgtctgggtctcctggacagtcgatcaccatctcctgcactggaaccaccactgacgttgctggttaataaatntctctcctggtatcaacaactaccaggacaaacgccccaaagtcatcattangatgtctataactcgccttcgagggttacaagtcncttctctgtcctcgatcgtcggcgacgcgtcctcctcgacctactcgtcgtcggcctccgagtctaggaacggacgacggtacttgtaacgtttattaccgtgtaccagtcctatacgtaagtacgacggtcacgactacgactacgttcgtacgggtttcggacgggtacggacgtacggcgtacggaccgttccgtaaggcccgacggtaccgaaccggtcgtacccggtccccgttgtacccg

SEQ ID NO: 151501 - DNA, 738 bp, Homo sapiens
  misc_feature: GYAE6OF02IHGPJ.7.5.A05.1.454.CMB.1.raw
  modified_base (196)..(196): a, c, t, g, unknown or other
  misc_feature (196)..(196): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtcctccgtggacngtcgatccaccatcctcctgcacgtacggaacccacctactggtaccgttgcttaggttaataaatctctctcctggtatacaacaactaccgagacaaacgaccccaaagtctatctatttatgtatcgtactaataacgtccggtccttacgtacgggtttaccaacgttcgtcttctcgtcggtctacgtaacgtcgtggaccgacgaccggtcctccctacgacctactcctcgtcggtcctaccgtacggtcgtaagaacggtacggacggtactagttaacgtttaacgttaacgtcgtacgtacggtcttacgaacttaacgtaacgaacgggtaccaacggtaaccgaacgtaccctaacggttacgggtttaccgggggttttaccggggaaccggggtaaccggggtaacccggtaacggtcccggttaccgggtaccccggttaacccggttaacggggtaaccgtacccgggtaaaccccggtaccgggttaccccggtcccggttccccccggttacggttacccccgg

SEQ ID NO: 151502 - DNA, 708 bp, Homo sapiens
  misc_feature: GYAE6OF02JC5ZC.7.5.A05.1.454.CMB.1.raw
  modified_base (185)..(185): a, c, t, g, unknown or other
  misc_feature (185)..(185): n is a, c, g, or t
  modified_base (358)..(358): a, c, t, g, unknown or other
  misc_feature (358)..(358): n is a, c, g, or t
tcagcgtgtctctacacgaccggtgctcgatttagatagatagacaggggggggggtctcaggaggcagcgctctcgggacgtctccaccatggcctgggctctgctattcctcacccgtcctcactcagggcacagggtctgggcccagtctgccctgactcagcctgcctcgtgcgtgggtcnccgtggacagtcgatcactatcctctgacacgtcggaacccacctactaggacgtttgaccgtttaggttaaactaaaacttctaccgttcgttaccgttaggttactaaccaaacgtaaacttacccaaggtaaccaaaacggacccccaaaagtcaacttctaactttagngtaacttcggtactaacgtaacggttcgtaccttacggtacgggtttacctaagtccggtacttactcgtacggtctacctagtcctggtaccgacgaccgtaccttcccgagtacctacgtccttacgcggtactaccgagtacgtacgaacgtacggaggtctaaggtacttaagttacctaggactaacgtcctaaggtaactagacgagtacgtacgaacgtcagttaaaccgttcggttacggttacgggacgggtaacgacggtaactccggttaccgtacggtaccggtttacgaacggtaacccggactaaccggtccgggtaccttacccgtccgtaaccg

SEQ ID NO: 151503 - DNA, 768 bp, Homo sapiens
  misc_feature: GYAE6OF02HOEV1.7.5.A05.1.454.CMB.1.raw
  modified_base (268)..(268): a, c, t, g, unknown or other
  misc_feature (268)..(268): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctggtctccgtggacagtcgatcaccatcctcctgcacgtggaacccaccacgtgacgttgcttaggttaataaatctctctccgtggtancaacaactaccgagacaaacgaccccaagtcatactactttatagtatgttactaataacgtcggtaccctttcgtacgggtttacctaacgttccgtccttttactccgttacggtccttacccgtaacgttccgttacgggaccgtacccgtaacccggggttcccctacccgttaccggtaaccctacttccgtttacccgtcgggtaccccgtaccgtacgggtacgttaacgggaacggaacggtaaccggttaccgtaggtttaaacctttaagtttaccgtcggacctacgtacgtaaccttaagttaaccgtaaccgaaggacccgtaagacctacgtacccgttaccgttacggttaaccgggtttcccgggacgggaaccgggtaccgaacggtccggtacccggttaacccgttacccggttacgggttaccaaccggaccccggtaaaccggtccgttacccccggtaccccgttcccggttaacccg

SEQ ID NO: 151504 - DNA, 699 bp, Homo sapiens
  misc_feature: GYAE6OF02GB484.7.5.A05.1.454.CMB.1.raw
  modified_base (306)..(306): a, c, t, g, unknown or other
  misc_feature (306)..(306): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccacgtgacgttgctaggttaataaatatctctcctgtatcaacaactaccaggacaaacgaccccaaagtcatactattagtnatgtactaataacgtcgtaccgttcgtacgggtttaccacgtcgtcttctctcggtcctacgacgtcgtcggtacgacgtaccggcctacccgtacgtaccctactttccgtcggtccgggtacctcccggacgggtacgtacgggaaacgtaaccgggtaggtacgttaacgtaacttttaacgttacgtcgtaccgtaacgttccgtaacgtaactaacgtaaccgacgggacgaaccggtactaccgtacgtaaccggtttcggtttaacgggtttaccgggacggggtaacggaacccgtacggtaccggtaccggtacccggtaccgtacggtacccgaccggtaaccggtaccggtccgtaccccggttaccccggtccgttacccg

SEQ ID NO: 151505 - DNA, 590 bp, Homo sapiens
  misc_feature: GYAE6OF02FQKP9.7.5.A05.1.454.CMB.1.raw
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
tcagcgtgtctctacacgaccggtgctcgatttagatagatagacgagggggggggtctcaggaggcagcgctctcgggacgtctccaccatggcctgggctctgctattcctccaccctcctcactcagggcacagggtcgtgggcccagtctgccctgactcagcctgcctcgtgtctgggtctcctggacagtcgatcaccatctcctgccactcggaaccaccacttggaccgtttgcgttaggttaactaaatcgtccttactccgtaggttactacaaactaactacccgaggaccaaacgacccccaaaagtccactactaattttangtatgtactatatcgtcttcggtaggttcatctcttcntcgctacagtcgcgacgacgcgtcctccgtcgactactcgtcgtcgctcgngctagaagcggacgtntagtagtttatacgngtacacgtcctataacgtatacgagcacgcgatccacgtgttacgggttcgggacgtaggacgtacgtccgaacggttccgtaccgtacggtaccacgtacccgtacgtcccgtacccgtccccgtagttacccg

SEQ ID NO: 151506 - DNA, 593 bp, Homo sapiens
  misc_feature: GYAE6OF02HOHXR.7.5.A05.1.454.CMB.1.raw
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (461)..(461): a, c, t, g, unknown or other
  misc_feature (461)..(461): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatccaccatcctcctgcacgtcggaacccaccactgtacgttgcttaggttaataatntctctcgtggtatacaaacaactaccgagacaaacgccccaagtcatctattangatgtactataactcgtcttcggtaggttaccatcgtcttctctggtcctacgtaacgtcgtaggcgaacgccgcccttacccgtacgacctctccgtacgtcggtcctcgacggtcgtaggaacgacgtacgctagtaacttagttacncgctagctctaatactagacgacacgcacgtctaacgtcgtaggtttcgggcggacggtaccgaggtcgtcggtaccgtcgtacgtacgtaccgaccgtaacggtcccgtacccggtccccgtgttaccccg

SEQ ID NO: 151507 - DNA, 778 bp, Homo sapiens
  misc_feature: GYAE6OF02GQN7G.7.5.A05.1.454.CMB.1.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagcgtgtctctacacgaccggtgctcgatttagatagatagacagggggggggtctcgaggaggcagcgctctcgggacgtctccaccatggcctgggctctgctattcctcaccctctcactcgaggcacgagggtcgtcgggcccagtctgccctgactcagcctgccctcgtgtcgtgggtcctcctggacagtcgatcacctatcctctgccaacgtggaacccacctacgtggacgtttgacttaggttaaacaaaattctcgtcctccgtagttataccaaanaactacccgacggaaccaaaccgacccccaaagtacactacctatttacnggtattacgtactaattaacgttaccggtcctttacggttacgggtttacctaacttcgtacttcctacgtaggtccttacgaagttccgtacggtaccgaacgtcccgggacccttaccccgttacggaaacctcgtacctccgggtcggttacctcccggtaacggtaccgtaacggtaacggaaccggtacgggtaccttaacggtaagttttaacgttaccgcgtacgtaacgtccgttaactaataaacggttcgacggaacgtacgtacaacgtacgtaacccgtttagggttaaccgggttttccgggggaaccggtacgggaacctaacgggttccctaccggggttaacccggttacccgagggttaccgtaacccggcccgtaacggggttccccttacccccgggtccccggttaaggttaccccc

SEQ ID NO: 151508 - DNA, 603 bp, Homo sapiens
  misc_feature: GYAE6OF02F2DHW.7.5.A05.1.454.CMB.1.raw
  modified_base (249)..(249): a, c, t, g, unknown or other
  misc_feature (249)..(249): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatntctctctggtatcaacaactaccaggacaaacgccccaagtcatctatttatgatgtctataacgtcggccttcgtagggtttccaagtcgtcttctctcgtctaccaagtcgtcggacgaccgacggtccctccctacgacctctccgtcggtcggcctccgaggtcgtaggaacgacgaggtctagtatttacttagtgctacgtctacattactacgaggtacagacacgtacctacgtcgttacggggtttaccggacgggtacgggaaccgtacggcgttaaccggtacccgtaccgtacggtccgaacggacccggtaaggtcccgcccggtccccgtcggttacccg

SEQ ID NO: 151509 - DNA, 783 bp, Homo sapiens
  misc_feature: GYAE6OF02IYCZ5.7.5.A05.1.454.CMB.1.raw
  modified_base (602)..(602): a, c, t, g, unknown or other
  misc_feature (602)..(602): n is a, c, g, or t
tcagcgtgtctctacacgaccggtgctcgatttagatagatagacaggggggggggtctcgaggaggcagcgctctcgggacgtctccaccatggcctgggctctgctattcctcaccctcctcactcgagggcacgagggtcgtgggcccaggtctgaccctgactcagcctgcctccgtgtcgtgggtctccgtggacagtcgactcgacctactcctctagcctacgtacggaacccacctacgtacgggtaccgtttagaccgtttaggtttaaaacttaaaacgttccttaccgttcctttaccggttagggttaactaaccaaaaacctaaacctaaccccggaaagggtaaccccaaaaacccgtaccccccgtaaaagtcgtaacttacttaattttaacggtagtaacgtttacgtaacttaactaaccggttccgtacctttacgggtaacggttttaccaagtcccgttctcttaccgtagccttactaagtcggtacggactaccgtacccggtcctaccgtcgaacctcgtcgcggtcggcttacgcgacgtaggaacgacgtacggtactacgttattacttaacgtnacgtctactactaagtaaccgactaccgggactacgtacgaccgtacgttaccggtacggtttacggggttacggggacccgggaacgttaaccggacgtccgggttaccgtacccggtaccggtaccgtccggaaccgtccggtaccgaacccggtccccttacccgggtactaaccccg

SEQ ID NO: 151510 - DNA, 671 bp, Homo sapiens
  misc_feature: GYAE6OF02J076Z.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtcgtggtctctggacagtcgatcacatctcctgcactgaaccacactgacgttgctaggttaactaaatctctctcctggtatacaacactaccgagacaaacgccccaaagtcatactattatagatagtactaagtaacgtcggtcttacggtacgggtttaccaagtcgtacttctcgtcggacctcgtaacgtcgtacgtaccgacgtaccggtcccttacccgtacgaaccctagttccgtcgtcgggtcctaccggacggtacgtacggaaagtacggacggtcgttaacgtaactttacgttactacggtacgtacgtcgtaataacttaacgacgtacggacgtaacgaccgtaacgtaccgtacgttaccggttacggggttttaccgggacgggaccgggtaaccaacgggtccgttaaccggacccgtacggtacgtaccgaccgtacccggaacggtcccgtcccgtcccgtccgtaacccg

SEQ ID NO: 151511 - DNA, 821 bp, Homo sapiens
  misc_feature: GYAE6OF02HHRVP.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactcggaacccaccactgacgttgcttaggttaataaatctctctcctaggtatacaacaactaccaggacaaaccgacccccaagtcctatacgtactttatagattagtactaagtaactccggtaccttcggtaacggggtttacctaacgttcgtccttctcgtcggtccttaccgaacgttccgtacgggaccggtaacccgtacccggtacccgttacccctacggtaacccctaacgtttcccgttaccggtacccgggttaccctaccggtaacgggtacgttaacggaaacgggtacggtaacgggtactttacggtaactttaacgtttaaccgtcgtaccgtaacgtcgtactaacgttaacgtaacgaacgggtaccgaacggtaccgaacgtacccgttaaccgggtttaccgggtttacggggttttaacccgggggtaaccgggggaacccgggtaaaccgtaacccgggttaaccggttaacccgggtaacccccgggtttaaccggttaccgggttaacccgaacccgggtaaccccgggtaaccgttaaccccggtcccccgttacccccccggtacgtttaaccccgg

SEQ ID NO: 151512 - DNA, 756 bp, Homo sapiens
  misc_feature: GYAE6OF02H6MZV.7.5.A05.1.454.CMB.1.raw
  modified_base (318)..(318): a, c, t, g, unknown or other
  misc_feature (318)..(318): n is a, c, g, or t
tcagcgtgtctctacacgaccggtgctcgatttagatagatagacaggggggggggtctcaggaggcagcgctctcgggacgtctccaccatggcctgggctctgctattcctcacccctcctcactcagggcacagggtcgtgggcccagtctgccctgactcagcctgcctccgtgtcgtgggtctcctggacacgtcgactccacctatcctcctgcactcggaacccaccactgacgttgtcgtggttaataaatactctctctggtatacaacaactacccagacaaaccgacccccaaagtcatacatttantatgtatataacgtcgtccttcgacggggtttccaagtccgtcttcctacgtgtcctaccaagtcgtcggacgaccgaccgtcccttcccgtacgacccgacttccgtccggttcgggtacccgtaccgcggtacggtacggaaacgggacgggtaacgtccgtagttaacgtttacgttaaccgtgaccgtacgtctaacctaagttaaactaccggaacggtaccgacgaaccgtaacgtaccgtaacccggttacggtttaccggggttttaccggggaccgggggtaaccggtaacccggaaccgggttacccgttacccgggttaaccccggtttaacccggtaacccgggttaccggaaaccccggtaacccggtaacccggggtccccgtttaccccccgggtccccccggtttaaccccggtacccccgg

SEQ ID NO: 151513 - DNA, 533 bp, Homo sapiens
  misc_feature: GYAE6OF02FWZD1.7.5.A05.1.454.CMB.1.raw
  modified_base (474)..(474): a, c, t, g, unknown or other
  misc_feature (474)..(474): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctcctgcactggaaccaccactgacgttgcttggttaataaatactctctcctggtatcaacaatacccaggcaaacgccccaaagtcatcatttatgatgtactataatcggtccttcgagggtttccaatcgtcttctctgctactaagtcgtggcacacggtcctccctagaccatctcgtcggtctcgaaggctagaagcgaggtctagatttacttactgacacgctctatactacgaggacagacagcactcgttaggtttcgngggacgacgagctacggaccgttcgacgtcgacgtaccgagccgtccgcccctgtaccg

SEQ ID NO: 151514 - DNA, 586 bp, Homo sapiens
  misc_feature: GYAE6OF02F7DXD.7.5.A05.1.454.CMB.1.raw
  modified_base (432)..(432): a, c, t, g, unknown or other
  misc_feature (432)..(432): n is a, c, g, or t
tcagcgtgtctctacacgaccggtgctcgatttagatagatagacaggggggggggtctcaggaggcagcgctctcgggacgtctccaccatggcctgggctctgctattcctcaccctctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaagcccccaaagtcatcatttatgaatgtctaataatcgtccttctagggtttcaattcgcttctctggctcaacgtctgcgacacgtcccgtccctacgacctactcgtctgggtcctccgagtctagtacgacgagcgtagagtttaattaacgngtactgtactccgtaatagtaacgacggtaccaggtacaggtaccaccgtcgtaaggttttcggacggggtaggaacccgtaagtccgtagacccgtccgttaacggtccgtaacggaccctaacgggcctccggtaccccccgtcgggtaccc

SEQ ID NO: 151515 - DNA, 608 bp, Homo sapiens
  misc_feature: GYAE6OF02H2GD9.7.5.A05.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (355)..(355): a, c, t, g, unknown or other
  misc_feature (355)..(355): n is a, c, g, or t
tcagcgtgtctctacacgaccggtgctcgatttagatagatagacagggggggggtctcaggaggcagcgctcgtcgggacgtctccaccagtggcctgggctctgctattcctcaccctcctcactcagggcacgagggtcgtgggcccagtctcgcctgactcagctgcctccgtgtctgggtctccgtggacagtcgatcacatcnctncangaaccncactgtacgtncttgtaataaatntctctcctgtactacaacaactaccaggacaaaccgtacccccaaagtcatctattactgtatcgtattataacgcggtccttcgtagggttttaccaacttcgtcttcncttacggctactagttcgtagaccgtaacgaccggtcctacccgtacgtaccctataccgtcgtcggaccttccgaacggtcacgtaaggacggacggtcgtagttaacttacgttacgtttacgacgtcgacttagactaacgttaccgaggcagacacgactcgtcgtgggtttacgacggacgacgtacggtacgtccgtccgtacggttacgcgacgtaccgacgtcgacccgtcccgttcgtacccgg

SEQ ID NO: 151516 - DNA, 543 bp, Homo sapiens
  misc_feature: GYAE6OF02FJHIB.7.5.A05.1.454.CMB.1.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (393)..(393): a, c, t, g, unknown or other
  misc_feature (393)..(393): n is a, c, g, or t
  modified_base (448)..(448): a, c, t, g, unknown or other
  misc_feature (448)..(448): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgcttggttaataaatntctctctggtatcaacaatacccagacaaagcccccaaagtcatcatttangatgtctataatcgccttgtacgggtttcaatcgtcttctctcgctcgaagtcgtcggcgacgacggcctcctcgacctatctcgtcggctcnggctagaagacgaggctagattattactgacacgctacatatacgagcagcagcncgtacgtacgggtttcggacgggtacggaccaggcgtacgaccggtccgtacggtcacggacccgaaggtccgtccggtcccccgtcggtacccg

SEQ ID NO: 151517 - DNA, 833 bp, Homo sapiens
  misc_feature: GYAE6OF02FW59P.7.5.A05.1.454.CMB.1.raw
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (718)..(718): a, c, t, g, unknown or other
  misc_feature (718)..(718): n is a, c, g, or t
tcagcgtgtctctacacgaccggtgctcgatttagatagatagacaggggggggtcgtcgaggaggcgagcgcgtctcggacgtcgtccaccactggcctcgggctctcgcgtattcctctaccctcctcactcacggcgaccagggtcgtcgggcccagtcctggccctgactcacgcctcgccttccgtcgtacgtcgggttctacccgtgggacctaggtcgtactactaccacttctcctncctacgtacggaccctaaaccnccggttanaaccgttcggtacttaggttaaactaaaattactccttaccgtccttacggtttatacctaaactaaccttaacctaaggaaccaaaacccgtacccgtaaaccggtaactaactacttaactttaacgttacgttacgtacgttacttaatttaaaaccgttccggttacccgttcgtttaaaccgggggttttaccgtaacgttaaccgtactttttccgtaaccggtttcggtcccgtaccgttaaacgtccgtttcggtacggaaccttaaaccgggtcccttacccgggaccgtaccctaacccggtttcgtacggttaccggtaccgtaccgttaccggtaccggttacggtaaaccggtaacggtaccggttacgtacggtaactttaacgtacgttacgtacgtacgaacgttctacgttactaaccgtacggtntaccggatacgacccttacgacgttcgtttcggagtaccggaacggtacgtacggtcgaccgtaccggttacgtacgtacgacccgtaacgtcgacccggtcccggtccgtaccg

SEQ ID NO: 151518 - DNA, 619 bp, Homo sapiens
  misc_feature: GYAE6OF02GT73T.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttaataaatatctctcctggtatcaacaataccagacaaacgccccaaagtcatcattatgatgtctataatcgtcttcgtacgggtttaccaatcgtcttctctcggtcctactaacgtcgttcggacgaccgtacggcccttccccgtagacccaacttccgttcggtcgggtcctccgtaacggccttaggaacggtacggacggtactaggtaactttacgttaactgacgtagctacaatactaacgagcgagtcgacgcctacgtcgtaggggtttccgagggtacggacgtaaggtccggtacgtacccggttccgtacgggtacctaccggtacccggaacggccttccggtacccccggttcggtaccccg

SEQ ID NO: 151519 - DNA, 656 bp, Homo sapiens
  misc_feature: GYAE6OF02ICTBQ.7.5.A05.1.454.CMB.1.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacagggtcgtgggcccagtctgccctgactcagcctgcctcgtgtctggtctcctgcagtcgatcaccntctcctgcactcggaacccacactgtacgttgcttaggttaataatctctctacctggtactacaacaactaccagaccaaacgccccaagtcatctatttatgtatntactataactcgtccttcgtacgggttacactctctctcgtcgtactaccagtcgtcggaccgacgaccggtccctccgtacgtaccacgtttccgtcggtccggtccgtaccgacggtacgtaacggtaacggtaccggtacggtactaacggttactttaacgttcgtacgacgtacgtcctagtaacttacgtaaccggcgtaccgacgaccgtaacgccgttaacgttcgggttaacgggtttcgggaccgggtaccggtaaccgacgtaccggtaccgtccggtaccgtacggtcccaaccggtacccgtaccgtcccggtccccggtcccgttaccggtcccg

SEQ ID NO: 151520 - DNA, 536 bp, Homo sapiens
  misc_feature: GYAE6OF02FTZEB.7.5.A05.1.454.CMB.1.raw
  modified_base (423)..(423): a, c, t, g, unknown or other
  misc_feature (423)..(423): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttaataaatatctctcctggtatcaacaatacccaggcaaagcccccaaagtcatcatttatgatgtctaataatcggccttcgtaggggtttccaatcgtcttctctggctccaagtctggcgacacgccctccctgaccatctctggctccgaggctggaagacgaggctgtattattacngcagctcatatacaggtcagcagcactcgtaggtttacggcgggacggaccgaagtcgtcgaccggtacgtacggtacacgccgaacggccgtccggtacccccgtggtaccc

SEQ ID NO: 151521 - DNA, 644 bp, Homo sapiens
  misc_feature: GYAE6OF02FJGA2.7.5.A05.1.454.CMB.1.raw
  modified_base (309)..(309): a, c, t, g, unknown or other
  misc_feature (309)..(309): n is a, c, g, or t
  modified_base (429)..(429): a, c, t, g, unknown or other
  misc_feature (429)..(429): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcgaaccaccactgacgttgctggttaaataaatactctctcctggtatcaaacaactaacccagacaaacgcccccaaagtcatactatttanagtatgtactataactccgtccttacgtacgggtttcaacgttcgtcttctcgtcgctacaacgtcgtcggtcaccgaaccgtccctccctacgacctactcttacgtcgggtcctccgnggtactcgaaacggacgtagccgttagtactttatttacgtgtcgacgtctcaacttaagtaccgaaggtccacgacgaacgtcctaaccgtcggttacggttttccgggaaccggtacgggtaaccgacggtaccgtacggtaaccccggttacgtacggtaaccgtacgacccgtaaacggtcccgtacccggtccccgttacggtaaccccg

SEQ ID NO: 151522 - DNA, 871 bp, Homo sapiens
  misc_feature: GYAE6OF02I9UOU.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcgtggacagtcgatccaccatcctcctgcctacgtacggaacccacctacgttcggtacgttgtaccgttaggtttaaactaaaattcttcccttccttccgttagggttaactacctaaaaccgtaaaccgtaacccccgtaaggaaccccgaaaaacccggtaccccccccgtaaaaacggtacctaacttaccgtaaacttttaagttacggtaactttacggttaacttaaacgttaaccggttacccgggttacccttttacggggttaaccggggttttaccctaaacgtttccggttaccctttccgttcggttaccggtacccgttaccgtaacggttcggtacggtaccggtaccgtacccgggtcccctacccgtaccgacctacgttcctcgggtacggtccgtaccgacgtacgaacggtaacgacggtaaggtcctagttaattaccgtttacgtaccgcgtaacgtcctaacgtaataaccgtacggtacgtccgaacgtaccggacgtacgttaccgttacggttaaccgggttaccggggtacggaccgggtaaccgtaaccgggtccgttaacccggttacccgggttaaccgttaccggtaaccgtacccggaaaccggtacccgggtcccggttacccccggttcccccggttaccggttaccccg

SEQ ID NO: 151523 - DNA, 693 bp, Homo sapiens
  misc_feature: GYAE6OF02HWZ4Q.7.5.A05.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (538)..(538): a, c, t, g, unknown or other
  misc_feature (538)..(538): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacagggtcgtgggcccagtctcgccctgactcagcctgcctccgtgtctgggtctccgtggacagtcgactcaccatcctcctgacacgtcggaaaccnccacgtgacgttgacgttaggttaanaaatnttcttctcctggtactacaacaactacccaggacaaacccgacccccgaaagtctaactacttaactttagtacgtagttcgttacgttaactaacgtccggttccttacggttacggggtttacctaactcgttacctttccgtaccgttgaccttccgtaacgttcgtacggacgtaccgaccggtccctccgtacacgtactcgtcgtcggctccgagcgaagacgacggacgtaccgtgttaaacgtttctacgtcggtacagttcctaanacgttacgaacgtacggtaccagtccgaacgtcctacggtacgttccggggtttacggaccgggtacgaacggtccgttggacccgtaccgtacggttaccgtaccggaccggtacccggaaccgttcccgtcccgtacccgttaccggtacccg

SEQ ID NO: 151524 - DNA, 789 bp, Homo sapiens
  misc_feature: GYAE6OF02FJA46.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcatcaccactctccgtgcacgtacggaacccaccacgtcgacgtttgcgttaggtttaactaaaattactccttcctccgtacggttatacctaaacgtaacttaacccacggaccaaaccgaccccctaaagtaccgaacttactaagttttactacggtattcgttactaactaacgttccggtccgtttacggttacgggtttaccaagttccgttacttccgttcgtcggtacccgttacctaacggttcggtacggaccggtaccggtaccggtcccgtacccgttaccggtaaccctacgtccgttcgtccgggtaccgtaccgtacgggtcggtaaacggaacggtacgggtacgtacggtagttaacgtttaacgttaccgtacgtacgtacgtcctaagtaacgttaacgtacggacggtacgtaacgtacgaccgttacgtacgtttacgggtaacggggtttccgggaacgggtaacggaaccgttaacggtacggttaaccggtacccggttaccggtaaccggtaccgacccggtaccggtaaccggtaccccggttccccgttacccggtacgttacccg

SEQ ID NO: 151525 - DNA, 762 bp, Homo sapiens
  misc_feature: GYAE6OF02GCXLW.7.5.A05.1.454.CMB.1.raw
  modified_base (211)..(211): a, c, t, g, unknown or other
  misc_feature (211)..(211): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatcctccngccactcggaacccaccacgtgtaccgttgcttaggttaataaatactctctcctgtatacaacaactacccaggaccaaacgacccccaaagtcactacatttatgatgttactaataacgtccggtaccttcggtacggggtttaccaagttccggtactttccgttacgtcggtaccttaccgtaacggttccgtacgggtaccgaccgtaacccgggtcccttaccccgtacggaaccccttagtccttccggtcgggtaccctaccggacggctacgggaaacgacggacgggtctagtactttaacgtttacgtcgtctacggtctactaacttactaacgaagggcctaacgacgtacgaccgtaaccgttaccgggttaacggggttttccgggaaccgggggtaaccgggtaaccgtaacgggtaacccggttaaccggtaaccccggtttaacgggttaacccgggtaccgtaaccccgggtacccggtaaaccggttccccggtaccccgggttccccccggttacccgggtttaacccc

SEQ ID NO: 151526 - DNA, 694 bp, Homo sapiens
  misc_feature: GYAE6OF02IVMBG.7.5.A05.1.454.CMB.1.raw
tcagcgtgtctctacacgaccggtgctcgatttagatagatagacgaggggggggggtctcaggaggcagcgctctcgggacgtctccaccatggcctgggctctgctattcctcaccctcctcactcagggcacgagggtcgtgggcccagtctgccctgactcagcctgcctccgtgtcgtgggtctccgtggacagtcgatcaccactctcctgctagttcggaacccacctactgggtaccgttgacgttaggttaaataaattctccttccttccgtaggtactaccaactaactaccgaggaccaaaccgaccccaagtctaatcgtaatttgagtattcgtaactaagtacgtcggttaccttacggttacgggtttaccacgttcgtccttctcgtcgaccttcgaacggttccgaggaccgtaccgtcccggtacccctacccgtacgtacctacgttcgtcgtacgggtcctacggtacggtctagggaacgacggtacggtcttaaggttactttaacttacgtacgcgtacgtcctaacgtatacaacggtcgagtaccaggtactaccgttacgtacggttacggggttccgggaacgggaccgtacggtacgtccggtaccggtaacgtccggtacgaccgacccggcgtaccggtccctcccggttccccggtagtccc

SEQ ID NO: 151527 - DNA, 680 bp, Homo sapiens
  misc_feature: GYAE6OF02G8DXY.7.5.A05.1.454.CMB.1.raw
  modified_base (212)..(212): a, c, t, g, unknown or other
  misc_feature (212)..(212): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctctncacgtggaaccaccactgacgttgctaggttaataaatatctctcctggtatacaacaactaccgacggacaaaccgacccccaaagtcaactctatttatgtatgtactaataacgtcggtccttcgtacgggtttccaatccgtcttctcgtgtcctactaagtcgtaggccgtaaccgccggtcccctccctacgaccctacttccgtccggtacgggtccaccggtacgggtaccgtaaggaaacggtaccggacggtcgttaagtactttaagttactcgtactacgtacttacgacttaacgacggtacggacagaccgacacccgtacgttacggttaccggggtttaccgggacggggttaccggaaccgtaccgggtcctaaccgggtaccggttaccggtacggtaccgaccggtacccggaccggtacccgtcccggtccccggtaccggttacccg

SEQ ID NO: 151528 - DNA, 613 bp, Homo sapiens
  misc_feature: GYAE6OF02I0KKY.7.5.A05.1.454.CMB.1.raw
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgctggttaataaatntctctcctggtatcaacaactaccaggacaaacgacccccaaagtcactctattangatgtactactaatcggtccttagtacgggtttaccaatccgtcttctctcggtcctacaagtcgtacggcaccgaccggtccctcccgtnaacctcgtctcgtccgggtcctccgacggtcgtacgaacggacgaggactgtaatttacttactgcgtactctactactaactacgtacggacagactcgacctaacgttcgttacgggtttacgggacggaccggtaacgtaacgtcggtaccggtaccgtccgtacggtacgaccgtacccggaccggtacctcccggtccccgtacgtacccgg

SEQ ID NO: 151529 - DNA, 718 bp, Homo sapiens
  misc_feature: GYAE6OF02FPMYV.7.5.A05.1.454.CMB.1.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctccgtgacngtcgatcaccatctcctgcactcggaaccnccactgacgttgcttaggttaataaatctctcctcctaggtactacaaacaactacccgtaggaccaaacgaccccgtaaagtcatactaatttatgtacttgtactaataacgtccggtacctttcgtaacgggtttacaacgttcgtaccttcgttcgtcggtctaccgtacgtacgtcggtcgaaccgtaccggtccctacccgtcgacctactccgtacgtcgggtcctaccggtaggtaccgtaacgggaacggtaccggtaggtacgtaacggttatttaaccgttacgtcgtacgtacgtctacttaacgtataacggacggtacaacgtcgtaacctctacccgttaggttaaccgggtttacggggaaccgggttacgtaacccggtacggtcccgttaaccggttacccggttaaccgtaccggtaccgtaacccggaccggtaaccggtccccgtacccggttcccccggtacggttaaccccg

SEQ ID NO: 151530 - DNA, 675 bp, Homo sapiens
  misc_feature: GYAE6OF02IRKWU.7.5.A05.1.454.CMB.1.raw
  modified_base (195)..(195): a, c, t, g, unknown or other
  misc_feature (195)..(195): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacngtcgatccaccatcctcctgcactacggaaccaccactaggaccgttgcttagttaataatactctctctggtatacaactaactaccaggaccaaacgaccccaaagtactactactaatttactgtacttgtactaagttaacgtccggttaccttacggtacgggtttaccaacgttcgtacttccgtcgtcggtcctaccgagtccgtggaccgaccgtaccggtccctcccgtacgtacccgtattcccgtacggtcggccgtaccgtacgggaccgtaacgggaaacggtacgggacggtcgttagtaactttaacgttacgtacggtaccgttagtacttacgtaattaacgtacgacggtaccacgacgacgtctaacgttcggtacgggttcggacgggacgtaccacggtcgtaccgtaccgtacgtacggtacgaccgtaccgtacggtccctccggtccctcggtacc

SEQ ID NO: 151531 - DNA, 776 bp, Homo sapiens
  misc_feature: GYAE6OF02FIHDE.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatcctcctgcctactcggaaccaccactgaccgtttgcttggttaataaaagtacttcttcctccgtggtacttaccaaacaactaaccccaggaccaaaacggccccccaaaagtaccactacctaattttaactagtatgttacctaagttaaacttccggtaccttcgtacggggttttaccaagttccgtctttcttcgtacgggtacctacgtaaacgttcgtacggcgtaaccgaccgggtccctaccccgtcgtaacccgtaccttcgtccgtcgggtaccttcccgaagggtccgttaacgggaacgaccggtaaggggtacctagtaacgtttaacttacgttcggtaccgtaacgtaccttactaacgttaacgttaacgaacgggacaacgggtcaacgtccgaaaccgttccggttaacggggtttttacggggacccgggtacggggaacccgtaacgggtccgtccggtaaacccggttaacccgttacgggtaaccggaccggtaacccggaacccgggttccgtaccccgggttccccccgtacggtttaaccccgg

SEQ ID NO: 151532 - DNA, 651 bp, Homo sapiens
  misc_feature: GYAE6OF02GIT24.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcacatctcctgcactcggaaccaccactgacgttgctaggttaataaatctctctcctggtatcaacaactaccgaggaccaaacgacccccaaagtccatctattatgatgtctatatcgtcttcgtacgggttaccatcgtcttctcgtcgtctacgtaacgtcgtacggacgacaccggtccctcccgtacgaccgtacttctacggtcggtcctccgacggtacgtaggaacgtacggtacggacttaggtactttaacttacgtggaccgtagtctactaacttacgtacgacggtacgacgacacgtactaccgttacggttagggtttccgggagggtacggtaaccgtacggtaccggttaccggaacccgttaccgttaacgggacctaccgggacccgtaaccgggtacccgtacccggtacccccggttcggtaccccg

SEQ ID NO: 151533 - DNA, 733 bp, Homo sapiens
  misc_feature: GYAE6OF02FZO99.7.5.A05.1.454.CMB.1.raw
  modified_base (163)..(163): a, c, t, g, unknown or other
  misc_feature (163)..(163): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (333)..(333): a, c, t, g, unknown or other
  misc_feature (333)..(333): n is a, c, g, or t
  modified_base (727)..(727): a, c, t, g, unknown or other
  misc_feature (727)..(727): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgccctgactnagcctgcctcgtgtctggtctcgtggacnggtcatcaccntccactgcacgtggaacccaccatgacgttgacgttaggttaaataaatctccttccgttcgtggtatactaacaaactacccgaggaccaaaccgtccccccaaaagtctaacttcctaatttttacgnggtaacttgtacttaaacgtaacgtccggttaccctttacggtacggggttttacctaaagttccgtcctttcctacgttcggaccttacccgtaagttcgtcgggaccgtaacgtacccggtccccttcccgaacgtaccgtaactttccggtccgttaccggggacctaccggttacggacgttacggaaacggtacggtaccggttcgttaccggtaattttaacggttacgtagttacccaacggtacctacttaacgttaaacgtacgacggacacgttacgacgttaccgtacgttacgggttaccggttttcgggacgggacgtaccaaggtccgtcggtacccgtcgttacgacggtaccaccggacgtcccgcccgttaccccgntacccg

SEQ ID NO: 151534 - DNA, 774 bp, Homo sapiens
  misc_feature: GYAE6OF02G668R.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcaggcacagggtcgtggcccagtctcgccctgacctcacgcctgcctccgtgtcgtcgggtcctccgtggacagtcgactcacatctccgcgcacgtcggaaaccaccactcggtacgttgacgttaggttaaattaaaattacttccttcttcccgttaggttaactacctaaaactaaacttaaccccgaaggaaccctaaaacccgaaccccccaaaaggttcctaaactccttaatttaactagtaacgttcgttaactaacgttaacgtaccgggttaccttacggtacggggtttaccaagttccgtctttctcgtcggtcctaccgtacgtcggtcggacgaccgtaccggtcccttcccgtacgtaccctacttccgtccggtcgggaccctaccgtacgggtcctagggaaaccggacggaggtccttaggtaactttaacgtttacgcgtacgacgtacctacgtagttacgtaacgcgtacgagtacctaggaccttacgttacggttaaccgggtttcgggacgggttacccggaacgtaaccgggtccgtaaccgggttacccgttcggtacgttaaccccggacgtacccggaacgttccccgtaccccgggtccccgtttacggttacccccg

SEQ ID NO: 151535 - DNA, 592 bp, Homo sapiens
  misc_feature: GYAE6OF02FN1AU.7.5.A05.1.454.CMB.1.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
tcagcgtgtctctacacgaccggtgctcgatttagatagatagacagggggggggttctcaggaggcagcgctctcgggacgtctccaccatggcctgggctctgctattcctcaccctcctcactcagggcacagggtcgtggcccagtctgccctgactcagcctgcctccgtgtctgggtctcctggacagtcgatcaccatcctcctgcactggaacccaccnctgacgttgcttggttactaaatactcttcctcctggtactacaacactacccaggccaaacgcccccaagtcatactattatnatgtctatactcgcctgtacgggttaccactctcttctctcgctacacgtctcggtacgcaccggccctcccgtcacccgctcctcgtcgggtcctaccgaggtactacggaacgacgtacggtcgtacgtacttacgttactcgcactcgtcaatacgaacgtagaccagaccgactaccgacttacggtacggtttacgggacgtaccggactacgtccgtacggacccgttactacggccgaccgacccgaggtccctcccgaccccgtcgtaacccg

SEQ ID NO: 151536 - DNA, 631 bp, Homo sapiens
  misc_feature: GYAE6OF02FVM4H.7.5.A05.1.454.CMB.1.raw
  modified_base (248)..(248): a, c, t, g, unknown or other
  misc_feature (248)..(248): n is a, c, g, or t
  modified_base (513)..(513): a, c, t, g, unknown or other
  misc_feature (513)..(513): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggtccagtctgccctgactcagcctgcctccgtgtctgggtctcctggacagtcgatcaccatctcctgcactcggaaccaccactgacgttgctggttataaatntctctctgtatacaacaactaccagacaaaccgcccccaaagtcatctattatgatgtactataactcggtccttcgtagggtttaccaacgttcgtcctttcgttcgtcggtcctaccgtaacgttcgtacggtaccgaccgacggtccccttaccctcggaccctctccgtcgtcggtccgtaccgtacgtcgtaggaacggtacggcggtaccttagtacgtttaattacgtcgacgagtcctactatactaacgtaggacncgacacgcacggttacgtaggggtttccgacgggtaccggaacgtacggtccgtaccgtacccggtacggtaacggtcgtaccgacccgacggtccgaccccggtcccgtccggtccc

SEQ ID NO: 151537 - DNA, 721 bp, Homo sapiens
  misc_feature: GYAE6OF02ICSMT.7.5.A05.1.454.CMB.1.raw
  modified_base (253)..(253): a, c, t, g, unknown or other
  misc_feature (253)..(253): n is a, c, g, or t
tcagcgtgtctctacacgaccggtgctcgatttagatagatagacagggggggtcgtcaggaggcagcgctctcgggacgtctccaccatggcctgggctctgctattcctcaccctcctcactcagggcactagggtcgtgggcccagtctgcctgactcagcctgcctccgtgtcctgggtctcctggaaccagtccgatcacctgtctccagcatggaaacctcatgaccgttgctaggttataaaactntctctccttggtactcaactaatacccgaggtacaaaacgccccaaaagtcactacattttacgagtactagttctaatactcggtccttagtacgggtttacccaaattcggtccttcgaccttgggtaccttaccgaagggttctagggacgtacgaccgcccttccgtagaaccctgtcccgttacgtcggtctcgaaacggtcgtacggaacgtaaccggaggtaccgttgggtaaactttacggttaacctttacggacgttacggtactcgtaaccgttacgttaaccgacggtaccgacgtacggtaagtaccccgttagttaccgttaacggggttttcccgggaacggggtaccggttaacccgaacggggttcctaccgggttaacccggttcccgttaacggtaccgtacccggttcgaaacccggtttcggccgtaccccggaccgtttaaccccg

SEQ ID NO: 151538 - DNA, 782 bp, Homo sapiens
  misc_feature: GYAE6OF02HBR0E.7.5.A05.1.454.CMB.1.raw
tcagcgtgtctctacacgaccggtgctcgatttagatagatagacgaggggggggggtctcaggaggcagcgctctcgggacgtctccaccatggcctgggctctgctattcctcaccctctcactcagggcacagggtcgtgggcccagtctgccctgactcagcctgcctcgtgtctgggtctcgtggacagtcgatcaccatcctcctgcactcggaacccaccactgacgttgcgttaggttaataaatacttcctcttccgtaggtataccaaactaactaacccgaggaccaaaccgacccccaaagtccattacctaatttagtagtacttagttactaaacgtaacgttccggttacccgtttacggttaacggggtttaccctaacggttccctttacgtttccttacgttcggtaccctttaaccgtaaggtttcccgtacgggacccgtaacccgtacccggttaccccccgtttccgtacccgtaaccccgtacgtttccgttccgggtaccgggttaccctccggacgggtacggtacggtaaacgggaccggtacgggtaccttaacggttaacttttaacgttacgtacggtaacgtaccggtcttaaccgaattaccgaacggtacgtacgtacgacgtacgtaccgttcccgttacggtttaacgggttccgggacggtaccggaaccgtaacggtcggtacccgtaccggtcttaacgggcctaccggtacccgagtccccgtacccggccccgttagtccccg

SEQ ID NO: 151539 - DNA, 693 bp, Homo sapiens
  misc_feature: GYAE6OF02GHB0H.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaaccaccactgacgttgcttaggttaataaatatctctccgtggtatacaacaactacccaggacaaacgcccccaaagtcatcactttaagtgatcgtacttaataacgtccggcctttacgtacggggtttccaagtccgtacctttctccgtacggtcctaccgtaacggtccgtgggtccgaaccgaccgggtcccttcccgacgaccctacgttctacggtcggccctcgaacgggtctacgggaaagtaccggaggtaccgttaggtaatttacgttaccgtgtacctaaggtccctacaagttaacgtaacgacgggtacacgtacgacgtactaccgttacggttaggggttccgggacgggtacggggacctacgggtcgtaccggtaccccggttaccggtacggtaccgaaccggtacccggaaacggttcccggtcccccggtaccccggttcgtaccccgg

SEQ ID NO: 151540 - DNA, 754 bp, Homo sapiens
  misc_feature: GYAE6OF02GYIUG.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtggcccagtctgccctgactcagcctgcctcgtgtctggtctcctggacagtcgactcacatcctctgcactcggaaccacacgtgacgttgctagttaataaatactctctcgtagtatacaacaactaccgaggaccaaaacgacccccaaagtccaactacctaatttatacgtattacgtactaagtaacgtccggtaccgtttacggtacgggttttacctaataccgttcttaccgtcgtacgtacccgtacgtaacgttctacgggccgtaaaccgcccggtaccctacccttacggaccctacgttccgttacggtacggtcctaccggtacggtaccgtaaggaaacgtaacggtacggtacgttacgtaaacttttaacggttaactacggtacctaaggtacccttaagtaaccgttaaacaaggaaccgggtaccacggtaaccacgtacccgtaacgggtttacttaccgggggttaacgggtaccggggaccgggtaacctaaggtacccggtaaccgttaccgtaacccggtaaccggaacgaaccgtacccggtaaaccggttcccgtaccccggttccccggttaaccgtaccccg

SEQ ID NO: 151541 - DNA, 643 bp, Homo sapiens
  misc_feature: GYAE6OF02HIKP4.7.5.A05.1.454.CMB.1.raw
  modified_base (213)..(213): a, c, t, g, unknown or other
  misc_feature (213)..(213): n is a, c, g, or t
tcagcgtgtctctacacgaccggtgctcgatttagatagatagacaggggggggggtctcaggaggcagcgctctcggggacgtctccaccatggcctgggctctgctattcctcaccctcctcactcagggcacagggtcgtgggcccagtctgccctgactcagcctgcctccgtgtctgggtctcctggacagtcgatcaccatctcctncacgtcggaaccaccactgacgttgctggttataaatatctctcctggtatacaacaactaccgaaggacaaaccgacccccaaacgtacacttctaatttagtgtatgtactaattaactcgtccttcgtacgggtttccatcgtcttctcgtgtcctaccgagttcgtggacgacgaccggtccctccgtacgacctacgtctacggtccggcctaccgaggtcctaggaacgcggacggtctagtaatttacgttacgtcgctacgtctactataacacgaggacacgtacgacgaccgtacgttcggttacgggtttaccgggacgggtacgggaactacggaccgtaccggtacccgttaccggttaaccgccgaaccgggtaccgaaccgggtcccgtcccggttacccccgtcggttaccccg

SEQ ID NO: 151542 - DNA, 684 bp, Homo sapiens
  misc_feature: GYAE6OF02IAD0Y.7.5.A05.1.454.CMB.1.raw
  modified_base (211)..(211): a, c, t, g, unknown or other
  misc_feature (211)..(211): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcgaggcacgagggtcgtgggcccagtctcgccctgactcacgcctcgcctcgtgtcgtcgggtcctcctggacagtcgatcacntctctgacactacggaacccacatcgtacgttcgcttaggttaataatctctctccgtagtacaacaactaactaccgaacggaccaaaccgaccccgtaaagtcctaatacgtttaacttttacgtagtaacgtcgttaacttaagttaaccgttcccggttaccgtttacgggtaccgggtttaacctacgttcctcgtttctacgtcgtacctacgtaacggtcgtcggacgaccgtccgtcctacctcgactctacgtccgngtacctacggngacgtagacgtacggcgtactgtattagtcagactacgtctaatacgtacacggacgtacacgtacgtacgtaccgttacggtcggtttacggggttacgggcgggtaaaccggccgaagtccggtaccgtaccgtaccggtacggaccgaccggtaacgtccgtacccggtccccgtaccccggtagttaccccg

SEQ ID NO: 151543 - DNA, 650 bp, Homo sapiens
  misc_feature: GYAE6OF02G3J7T.7.5.A05.1.454.CMB.1.raw
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (503)..(503): a, c, t, g, unknown or other
  misc_feature (503)..(503): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccacactgtacgttgcgtggttaataaatctctctctgtatacaacaactaccgagacaaacgaccccaaagtcatntattangtatgtactataactcggtaccttagtacgggttacaacgtctcttctcgtcgtactctaacgtcgtacggcgaccgtaccggtccctcccgtacacctactcctacgtcgggacctccgacggtctaggaaacgcggtacgtacgttagtaatttacgttacgtcgcgtacgcttaacacgttaacgtaacgacggtnacgacgtaacgccgtacgtttaacggttacgggtttacgggacgggacgggtaacccgaacggtccgttacggtaacccggttccgttaacgggtacctaacgggaacccgtacggtacccctcccggtaccccgtcccgttaaccg

SEQ ID NO: 151544 - DNA, 675 bp, Homo sapiens
  misc_feature: GYAE6OF02IKEVI.7.5.A05.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagcgtgtctctacacgaccggtgctcgatttagatagatagacaggggggggggtctcaggaggcagcgctctcgggacgtctccaccatggcctgggctctgctattcctcaccctctcactcaggcacgagggtcgtgggcccagtctgccctgactcagcctgcctccgtgtntgggtcctctggacngtcgatccaccatctcctgacacgtgaacccaccatgacgttgcttaggttaaataaacgtctcttctcctggtactacaaacaacgtacccgagaccgaaaccgacccccaaagtccatcctatttagtgtactgtactatactcggtccttgtacggttctagtctcttctcgtcgctacgagtctggcctacgccgcctccanacctntctcgtgccncaggctaggaacnccgggatcgtacgttatttacgtacgtacgtacacgtcgtactacgtaaacgtcgtaacggtacccgtagaccttaccggaaaccgtttcggttaaccggttttaacggggggttcccgaaccgggggtaaccgttaacggaacccgggttcttacccggtaccccggttttaaaggtccggttaacccgacgggttaacccccacggggttacccgtaccccccggttacccgtcggttaacccccg

SEQ ID NO: 151545 - DNA, 628 bp, Homo sapiens
  misc_feature: GYAE6OF02GYE3K.7.5.A05.1.454.CMB.1.raw
  modified_base (260)..(260): a, c, t, g, unknown or other
  misc_feature (260)..(260): n is a, c, g, or t
  modified_base (496)..(496): a, c, t, g, unknown or other
  misc_feature (496)..(496): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacgagggtcggtgggcccagtctgccctgactcagcctgcctccgtgtctgggtctccgtggacagtcgatccaacctatctcctgctactaggaacccaccactgacgttgcttaggttaataaatntctctctggtatacaacaataccagacaaacgacccaaagtcactactattatgtatagtactaataacgtcgtaccttacggtacgggttaccaacgtcgtacttcttcgtacgtcctaccgtaagtcgtcggacgaacgtaccgcctaccctacgaccactccgtgtacggtcctacgtacggatacggaagacggagacgtacgtattaacgttacgacgtacgagtacctanaagttagtaacgaagtacgtacgacgacgcaaccggttacgttaacgggtttacgggacgggacgaccgaacggctaacggtaccgtacgacggtacgacgacgaccgtccgtacccgtcccgtacgtaccg

SEQ ID NO: 151546 - DNA, 682 bp, Homo sapiens
  misc_feature: GYAE6OF02HWAH2.7.5.A05.1.454.CMB.1.raw
  modified_base (259)..(259): a, c, t, g, unknown or other
  misc_feature (259)..(259): n is a, c, g, or t
  modified_base (503)..(503): a, c, t, g, unknown or other
  misc_feature (503)..(503): n is a, c, g, or t
tcagcgtgtctctacacgaccggtgctcgatttagatagatagacgagggggggggtcgtcgaggaggcagcgctctcgggacgtctccaccatggcctgggctctgctattcctcaccctcctcactcgagggcacgagggtcgtcggcccagtctcgccctgactcacgcctcgcctccgtgtcgtgggtctccgtggacagtcgatcacatctcctgcagtcgaaccacactgacgttgcttaggttaataaactntctctcgtgtactacaaactaactaccgaggacaaaccgaccccgaaatactaactactatttagtagtatcgtacttaagtaacgtccgtcttacgtacgggtttaccaacgtcgttcttctcgtcgtacctactaacgtcgtcgacgtaaccgtaccggtcccttcccacgtacctacgttccgtcgtcggtcctaccgcgtacgtagaacgacgtaggtctaagttacttacgtacgttcncggttactacttactaacgtacgtaacgtacgacgtacgtacacgttaccgtaacgttcggttaacggggtttacgggaccggtaacggtacgtaaccggtcgtaccgtaccggtccggtaacggtaccgtacccggaacccgtcggacccggttcccgttccccggtaccgttacccg

SEQ ID NO: 151547 - DNA, 639 bp, Homo sapiens
  misc_feature: GYAE6OF02I0CBY.7.5.A05.1.454.CMB.1.raw
tcagcgtgtctctacacgaccggtgctcgatttagatagatagacaggggggggggtctcagggaggcagcgctctcgggacgtctccaccatggcctgggctctgctattcctcaccctcctcactcagggcacagggtcgtgggcccagtctgccctgactcagcctgcctcgtgtcgtgggtctcgtggacagtcgatcaccatcctcctgctactggaacccacactcgacgttgacgttaggttaataatactctctcgtagtatacaacaactaccgagacaacgacccaagtcatactattatagtatgtactatacgtccgtcgttcgtacgggttacacgtcgtacttcgtacgtcggtactaccgtaagtcgtacggaccgtaccgacccggtccctacccgacgtaccgtactccgtcgtcgggtccctacgaacggtcgacggaacggacggtacgtactacgtaactttaacgttacgtcggactacgtactactaagtacgtacgacgcgacgactacgtctacgttacggtacgggttacgacgggacgaccgacgtaccgtccggtaccgtacgtacgtaccgaccgtaccggtacgtcccgtacccgtccgttccgtacccg

SEQ ID NO: 151548 - DNA, 660 bp, Homo sapiens
  misc_feature: GYAE6OF02I6VKS.7.5.A05.1.454.CMB.1.raw
  modified_base (250)..(250): a, c, t, g, unknown or other
  misc_feature (250)..(250): n is a, c, g, or t
  modified_base (444)..(444): a, c, t, g, unknown or other
  misc_feature (444)..(444): n is a, c, g, or t
tcagcgtgtctctacacgaccggtgctcgatttagatagatagacgaggggggggggtctcaggaggcagccgctctcgggacgtctccaccatggcctgggctctgctattcctcaccctcctcactcagggcacagggtcgtgggcccagtctgccctgactcagcctgcctccgtgtctgggtctcctggacagtcgatcactatctcctgcactggaacccacactgacgttgctggttataaatntctctcctgtatcaactaactaccaggacaaacgacccccaagtcatactatttatgtactagtctaataactccggtaccttacggtacgggttaccaagtccgtcttactcgtcggtaccttaccgaacgttcgtaggaccgtacgaccgtcccttaccctacggacctacttccgtcgtcgggacctccgnggtacgtaggaacggacggtagtccgtagtaactttaacgttcgtcgtacgactcctcaattacgtaacgtacggaccgaagccgtacgccgtaacgttacggttaggggtttacccgggacgggaccggtaacgtacggtaccgtacccgtaaccggtcgaccggttaccgacggtacccgtaaggtcccggtacccgtcccccggtgttacccg

SEQ ID NO: 151549 - DNA, 677 bp, Homo sapiens
  misc_feature: GYAE6OF02JMUQ6.7.5.A05.1.454.CMB.1.raw
tcagcgtgtctctacacgaccggtgctcgatttagatagatagacagggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctctgcactgaaccaccatcgcgttgctggttataaatatctctctgtatcaactaactaccagacaaacaccccaaacgtctaatctattatcgatgttctaactaagtcgtccttcgtacgggtttaccaagttccgtctttcttcgtcggtccttaccgtaagttccgtcggtccgtaaccgaccggtccccgttaccccgtacgtaaccctacgttccctcggttccgggtcctttacccggaacggtcggtacgtaaacgggacggtacggttaccgtaggtaactttacttaacgtcgtagaacgtcctacgtattacgaacgtagggcctaacgacacgtacctacgttacgttacgggtttaccgggcgggtacccggaggaacggttcaccgggttaactccggttacggaccgtaaccggtaacccggtacggtccgtccccggtccccgtacggttacccg

SEQ ID NO: 151550 - DNA, 781 bp, Homo sapiens
  misc_feature: GYAE6OF02GYFA1.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggcacagggtcgtagggcccaggtctgccctgactcagcctgcctcgtgtctgggtctcctggacagtcgatccacctatcctcctgccacgtcggaaacccaccacgtggtaccgttgacttagggttaaataaaagttctactcttccgtaggttaactacaaacctaactacccgaggaaccaaaaccgaccccgtaaagtctaacgtacttaagtttactaggtaacttgttactaagttaacgtcccgggttaccttaccgggtacgggtttaccaacgttccgtcttactcgtcggtcctacgtaacgtcgtcggacgacctccgtcccgtcctacgacctacgtccgttacggtccggtccgtaccgaggtacgtacggaacggtacggtaggtacttaggtaactttaacgttaccgtacgtacggtaccgttacttaacgtaacgttaacgtccgtaacggtcgtacgtaagtaaccgtacgttaaccgttacgggttaaccgggtttacgggaaccgggtacgggtaaccgacgggttacccggtaaccggttaacccggtaccggtttaacgggtacccggtaaccgtcccgggtaaccggttaccccgttcccccgggtaaccccgttcgttaaccccgg

SEQ ID NO: 151551 - DNA, 816 bp, Homo sapiens
  misc_feature: GYAE6OF02IWQ1T.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctcctggacagtcgatcaccatcctcctgccactacggaaccaccactgaccgttgcttaggttaataaatatcctctccgtggtatacaacaactaccgagccaaacgaccccctaaagtcaatactaactttataggtattacgttataataacgttaccggtccgtttcggttaacggggttttaccaacgttccgttaccttaccttcgttcggtaccttacccgtaaggttccgtacgggaccaaccgtacccggtccccttaccccgtacgacccttacttcccgttcggtccgggtaccgtacccggtacggtaaccgttacggaaacggtaccgggtaacgggtaccttaggttaacttttaaccggttaacgttcggtaccgtaccgttacctacgtaaacgttaacgttaaccggaacgggtcctaacggaccgtacgtacccggttaacgttacccgggtttaggggtttttacccggggacgggggtaaccggggtaacccgtaacggtcccggttaacccggtacccgggttaaccgtttaccgggtaaccgtaacccgggaacccggttaccgggttccccgacccccggttaccccccgggttccgttaaccccgg

SEQ ID NO: 151552 - DNA, 650 bp, Homo sapiens
  misc_feature: GYAE6OF02G6ZLW.7.5.A05.1.454.CMB.1.raw
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatcctcctgcactcggaacccaccactgacgttgctagttaataaatatctctccgtggtatacaacaactacccaggacaaacgacccccaaagtcatctattatnatntactatactcgtccttcgtacggttccatcgtcttctcgtgcctacgtacgtcgtcggaccgaccgtaccgtccctccccgtacgtaccctacttccgtccgtcgggtccctcccggaacgggtccgtaacggaacgggaaccggtacgggtacgttagtaactttacgtttaccgtcgtacacggtcctactacgtaatacgaggacagaccgtagacctacgttacggttacggggtttccggacgggtacggaccgtacggtccgtacggtacccgtacgtacggtaccgacggtacccgacggtcccgtacccggtccccgttcggtacccg

SEQ ID NO: 151553 - DNA, 610 bp, Homo sapiens
  misc_feature: GYAE6OF02IVYM6.7.5.A05.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (474)..(474): a, c, t, g, unknown or other
  misc_feature (474)..(474): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacgagggtcgtgggcccagtctgccctgactcagcctgcctccgtgtctgggtctcctggacngtcgatcaccatcctcctgcactggaacccaccatgtacgttgcttaggttaataaatntctctcgtgtatcaacaactaccagacaaacgacccccaagtacatactatttagtgatgtactaatagtcgtacttcgtagggtttaccagttctctttgtctcggctaccgagttcgtcggcgcgaccgtccctaccctcgaccctatcctcggtcggtcctcgacggccgtaggaagacggcgtagtatacgtttaattcgtacgtcgtacgctanattacacgagctagccagactaccgtacgttcggggtttacgggcggtacggaaccgtacggaagttcccggaaccggttacgtaccgggtacctaccggacccgtacgcccgttcccggtaccccgttcgtaccc

SEQ ID NO: 151554 - DNA, 738 bp, Homo sapiens
  misc_feature: GYAE6OF02FZ77G.7.5.A05.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (530)..(530): a, c, t, g, unknown or other
  misc_feature (530)..(530): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctcgccctgactcagcctgcctccgtgtctgggtctcctggacagtcgatcaccatctcctncacgtgaacccacactgacgttgctaggttaataaatntctctctgtatcaanaacaccgagaccaacgaccccaaagcatactattatgatcgtataataacgtcgtccttacgtacgggttacctaatccgtcgtttcctagtcggtccctaccgtaggttaccgttaggggcccgtaaccgaccccgggtacccttcccccgttacgaaaccctacttacccttcgggtccgggtccttacccggacggggtaccgtaacggtaaaccgggaaccgggtagggtaccttaacggttaattttaaaccgtttacncggtaacctaacgtcctacgtaaacttacgtaacgaagggtccacggaccgaagcccttaacggtaccggttttaacggggtttcccggggacggggtaacgggaaccgtaacggtcccggttaggttacccccggttaggtaacccggtacgacccggttaacccggaccggtaccccgttcccggtaccccccgttacggtacccg

SEQ ID NO: 151555 - DNA, 797 bp, Homo sapiens
  misc_feature: GYAE6OF02H5OYS.7.5.A05.1.454.CMB.1.raw
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
  modified_base (280)..(280): a, c, t, g, unknown or other
  misc_feature (280)..(280): n is a, c, g, or t
  modified_base (787)..(787): a, c, t, g, unknown or other
  misc_feature (787)..(787): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcgaagggctacgtagggtcgtcgggcccagtctggccctgactcncgctcgcctcgtgtctcggtctcgtcggacaggtcatccacntcctcctgccacgtacggaaaccctacctaggtgtaccgtgtacttaggttaaactaagtctcctntccgtatactacaacgaactccgaagtcaaaccgtcccaaatcgtcttataacttaacgtgtattcgtaactaacgtcgttcccggtacgtttcgtaaaccgggttctacgtccgtccttcggtaccgtaggttaccctacggtaacgttcgggtaccgaaccggttacccggtccgtaaccccttccggggtactaacccgttacgtttacccggtccggtaaccgggtcctttaccgggtaacgggtacgtaaaggtaacccggtaggggtaccgttcccgttaattaacccggttttcgtaaaaccggttcgtaacgtcgttaccgttaaactaacgtaacggttcccggaaatcgtaaacggacttaccggtaacggttccgttaacggttccgggttaacggaccggttaccggtaccgtaagggtccctaaacccgggtttccaaacgggttacccggtaacgccgggtaaccctccggttacccggcccttaccccgggngttaaccccg

SEQ ID NO: 151556 - DNA, 534 bp, Homo sapiens
  misc_feature: GYAE6OF02HHBB4.7.5.A05.1.454.CMB.1.raw
  modified_base (441)..(441): a, c, t, g, unknown or other
  misc_feature (441)..(441): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccacactgacgttgctggttaataaatatctctcctgtatcaacaataccaggcaaagcccccaaagtcatacatttatgatgtctataatcgccttctaggggtttccaatcgcttctcgtgctcaagtctgcgcacgcctccctgaccatctcgtcggctccaggtcgtagaagacgaggctgattagttactgcacgctcatatacgacgtcaagcganctactcgtaaggtttcgggacggcggtaacgaacgtcgtacggtaccgtccgtaggtcacggaccgacggtccgtcgtccccgttcggtaccg

SEQ ID NO: 151557 - DNA, 801 bp, Homo sapiens
  misc_feature: GYAE6OF02H84CB.7.5.A05.1.454.CMB.1.raw
tcagcgtgtctctacacgaccggtgctcgatttagatagatagacgagggggggggtctcaggaggcagcgctctcgggacgtctccaccatggcctgggctctgcttattcctcaccctcctcactcgacgggcacgagggtccgtgggcccctagtctcgccctgactcagcctgcctcgtgtcgtgggtcctctaggactgtcgactccactatctctgcactacggaaccctacactgacgttgcttaggttaaataaatcttctcttaccgtgtactacaacaacgtaccgaagaaccaaaccgacccctaaagtcctaactacttagtttaactggtattacgtactaagttaacgtccggttacttttacggtacgggtttacaactttcgtcctttcgtcgtcggtctacgtacgttctcgggaccgtaccgtcccgtcccttacccgacgtacccgtacttccggtccggtaccggtaccgttaccggaggttacgtaacggtaaacgggtccggagttaccgtagttacttaacgttctaccggtactacggttcctaattaacgtacggttaacgtaccggtaccgtaggtaaccgtaacttaccggttaccgttcgggtttaacccgggggtttaacgggacggggtaaccgggttaaccggtacgggtaacccggttaaccggttacccggtaccgggttaaccggtaacccgtacccgggtaacccgggttaaccggttcccccgggttttaaccccggtaccccccgggttcccggttaaccccgg

SEQ ID NO: 151558 - DNA, 561 bp, Homo sapiens
  misc_feature: GYAE6OF02G4940.7.5.A05.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (419)..(419): a, c, t, g, unknown or other
  misc_feature (419)..(419): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctgacngtcatcacntctctgcactggaaccaccactgacgttgcttggttaataaatntctctccgtaggtctacaaacaactaccgaggaccaaacgcccccaaagtcatctatttatgactgtactaataagtcggcctttcgtagggtttaccaatcgtcttctctgcttcaagtcgtggacgacacgtcctccctgaccactctcgtcgctccgagtcgtagagacgngtctagtattacttcgtacgatacgtctacgtaatacgtacgacggtcagccaagtcctacgtacgtacgggtttcggaggacggtaccaggtccgtacgaccgtacgcgtacgacgtccgacgccgtccgtccctgtaccc

SEQ ID NO: 151559 - DNA, 730 bp, Homo sapiens
  misc_feature: GYAE6OF02GKEHX.7.5.A05.1.454.CMB.1.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactcggaaccaccactgacgttnctaggttactaaatntcctctcctggtactacaacaactacccaggtccaaacgacccccaaagtctaactctaatttatacgtacttaggtcttaagtaacgttccggtaccttacggtaccggggtttacctaaacgttcgtaccgttcgttcgtcgggtacctaccgtaacgttcggtacggaccgtaacgacccgggtccccttcccgtacggaccctacctaccgttccgtaccgggtcctaccgtacggtaccgtaggaaacgtacgggtacgtcgttaacgtagtttacgttaacgttcgacgttacgtactctaacgttaacgtacgtacggtaccagtaccgtacgtaccgtaaccgttaccggttagggtttccggggacgggtaccgggtacgaccggttacggtaccggtacccggtaccgttaacggtaccgtaacccggaccgtaaccggtcccggtcccgtacccccggtctaaccccg

SEQ ID NO: 151560 - DNA, 608 bp, Homo sapiens
  misc_feature: GYAE6OF02FRD4S.7.5.A05.1.454.CMB.1.raw
  modified_base (256)..(256): a, c, t, g, unknown or other
  misc_feature (256)..(256): n is a, c, g, or t
  modified_base (327)..(327): a, c, t, g, unknown or other
  misc_feature (327)..(327): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacgagggtcgtgggcccagtctgccctgactcagcctgcctcgtgtcgtgggtctctggacagtcatcacatctcctgcactcggaaccacctactcgacgttgcgttaggttaataaaactntcttctccgtaggtatacaaacaactacccgaaggaccaaaacgacccccaaagtccaatactacttttangattgtactaataacgtcggcctttgacgggtttaccaagtcgactttctacgtggtcctaccaagttctacggcgaaccgacggtaccctcccgagtaccactcgtcgtacgggtctaccgaggtactacggaaagtacggaggtccgtagtatttacgtactgccgatctataatactacgacgcagcaacgctaacgtcgttagggttcgacggacggacctagacgtccgaccgttcgagtacacggacctaacggcctcccgccccgtaggtaccc

SEQ ID NO: 151561 - DNA, 668 bp, Homo sapiens
  misc_feature: GYAE6OF02JNYY8.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtcgtgggtcctcgtggacacgtcgatcaccatcctccgtgcacgtcggaacccaccactgtaccggttgccgttagttaataactatctctccgtagtatacaacactaccaggacaaaccgacccaacgtacactactatttagtagtatacgtacttaagtacgtaccggtccgtttacggtacgggtttacctaacgttccgtacgttccgtacgttcggtacctaaccgtacggttacctcgggaccgaccgtaccggtcccttcccgtacgacctaactcgttccgtcggtaccctcgacgggtccgtacggaacgacggacggtcgttaagtacgtttaacgttacgtacgactacgtctactagtactacgtacgtcgacgtacgcgtacgtaccgttcggtacgggttcgggacgggacggacgagaccgttcgaccggttcacggtacgcgaccggtcgcccggtccgacccgtcgttacccg

SEQ ID NO: 151562 - DNA, 680 bp, Homo sapiens
  misc_feature: GYAE6OF02HZJ0R.7.5.A05.1.454.CMB.1.raw
  modified_base (274)..(274): a, c, t, g, unknown or other
  misc_feature (274)..(274): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctggtctccgtggacagtcgatcacctatcctcctgcacgtcggaacccaccactggtacgttgcgttaggttaataaatatcctctccgtggtanaccaaactaactacccgaggtacaaaccgacccccaaagtcatactatttatgtatgtactatactcggtccttagtacgggtttaccacgttcgtccttctcgttcgtcctacgtaacgtcgtacggaccgaccgtaccggtccctaccgtcgtaacctgttcccgttcggtcgggtacctccgacgggtctaacgggaaacgtacggaggtctagtttagttaacgttcgtacgctacgtctaacttacgtactaaccgagtcccgaatccggaaccgttcgtaccgttacgggtaacgggttcccgggacggtaccgggactaacggtccgttaccggtaccgttaccgtacggtacccgagaaccccgtaggtccccgtacccgtccccggttacgtacccg

SEQ ID NO: 151563 - DNA, 741 bp, Homo sapiens
  misc_feature: GYAE6OF02JMHCR.7.5.A05.1.454.CMB.1.raw
  modified_base (164)..(164): a, c, t, g, unknown or other
  misc_feature (164)..(164): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacaggggtcgtcgggcccagtctgccctgactcancctgcctcgtgtctgggtctctggacagtcgatcaccatcctcctgcactcggaacccaccactcgtacgttgcgtacggttaataaactctctacctcttaggtactacaacaaactaccgaggaccaaaaccgaccccaaagtaccactactacttatcgtatgtactatacgtcgtccttcggtacgggttacctaatccgtcttcctcgtacggtcctacgtaacgtcgtacggtacgtaacccggtaccgtcccctttcccgcgtaaccctacgttccgttacggtccggtcctaccggacgtaccgtacggaaacgtacgggacggtacgttacgttaacgtttaacgttcgtacaaccgtacgttaccgtaaccgtaataaccgtacgaaacggtccaaacggtccgaccggtaaccgtcgttaccgggttaacgggtttccggggaaccgggggtaccgaacggtaaccggtccttaacccgggtacccggtaacccgttaacggaaccccgaccggtaacccgtaacccgggttaccggtccccccggttaccccgttaccgggtacc

SEQ ID NO: 151564 - DNA, 760 bp, Homo sapiens
  misc_feature: GYAE6OF02GEK03.7.5.A05.1.454.CMB.1.raw
  modified_base (184)..(184): a, c, t, g, unknown or other
  misc_feature (184)..(184): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctggtcncctggacagttgatcaccatctctgcactggaaccacatcgtacgttgctaggttaataaagtctctactccgtgtactacaacaactaccgagacaaacgaccccaaagtcaatacgtatttacgtagattacgtactaattaacgtcggtaccttacgttacgggtttaccaattcgtaccttccgttcgtacggtcctacgtaacgtcggtacggacgacctaccgggtcccttacccgtcgaacctacgtccgttacgtcgggtcctaccgaacggtcgtaacggtaaccggtacggaacggtctacgtaacgttttacgttaacgttcgacgtacgacgttaaacgtacgtaacgtaacggaggtccgtaaacgggtcgaccgtaccgttaacggttcccggttaagggtttacccgggggaacggttaaccgggaaaccgaaccggggttaacctttaacccgggacccggtttaacccgggtttaaccgggtaacccgtaaaccccgggttacggaaaccccgggtcccttttacccccgggaccccccgtttacggggtttaaccccg

SEQ ID NO: 151565 - DNA, 728 bp, Homo sapiens
  misc_feature: GYAE6OF02ICS13.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcgaggcacgagggtcgtgggacccagtcctgaccctgacctcacgcctcgtccctccgttcgtcgtcgggtcctccgtggacctagtcgacttaccacctactcctccgtcgacctacgtaccggaacccaccgtacgtacggtaccgttcgtacgttaggttaataacgttacttccttccttccgtacggttaactactaaacgtaaccacccgtaacggaaccaaaccgacccccgtaagtacctacttacgttattagtacgtacttacgtactactacgtccggttccgttacggtacggtttacaacgtcgttccttactcgtcgtctacgtagtcgtcggcgtaaccgccgtaccctccgtaacgtacctacgtccgtgtaccgtcctaccggcgtacgacggaacggtacgaacggtcgttaagtacttacgtcgttacgcgtagtacctacgtaactacggttacgacggtaccagtaccacgttaccgtacgttcggtaacggtcggaacgtaccggaacgtcgtaacgtccgtacgtaccgtacggtccgaaccggtcgtaccggtaccgtcccgtacccgtacgttacccg

SEQ ID NO: 151566 - DNA, 615 bp, Homo sapiens
  misc_feature: GYAE6OF02FJ5NX.7.5.A05.1.454.CMB.1.raw
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
  modified_base (442)..(442): a, c, t, g, unknown or other
  misc_feature (442)..(442): n is a, c, g, or t
  modified_base (486)..(486): a, c, t, g, unknown or other
  misc_feature (486)..(486): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgccactcggaaccaccnctcgacgtttgcttggttaataaactntcctctccgtagtataccaacaactacccgaggaccaaacgaccccctaagtcacgttactaagtttangtattgtactaataacgtccggtcttcggtacgggtttccagtctcttcgcgtggtccacgaagttcgngcgaccgaccgtccctcccgngacctactccgtcgtcgggcctaccgngtacacggaagtcggaacgtgtacgttattaacttacgtcgacntcctcaatacttacgaggcacgcaacgtctacgttgtacggttccggagggtacgactaggcctacggacccgttagtacgtaccgacggtcccgaaccggtaccctcccggacccgttaccggtaccg

SEQ ID NO: 151567 - DNA, 730 bp, Homo sapiens
  misc_feature: GYAE6OF02JKSEG.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcactggaaccaccactgacgttgctggttaataatatctctctggtatcaacaactaccaggacaaacgcccccaaagtccatcgtattatgatgtactaataactcgtccttacgtagggtttaccaatccgtccttctcgtcgtcctacctaacggttcgtcggaccgtaccgaccggtacccttcccgtacggtaaccctacgtccgttaccgtcggggtaccctacccggacgggtaccgtaacggaaacggaaccgtacggtaccgttaggtaacttttagttaccgttacgaccggtacgtaccgttacgaacttaacgaaccggtaacgggtacaacggaccgtaccggtaccctaaaccggttacgttaacggggtttaccgggaccgggaaccggttaaccgtaacggtacccggtaccgttaacccgggtaccggttaacggtacccgtaaccggtaccccggtaaccggtacccgttacccccggtccccggtaccggttaaccccgg

SEQ ID NO: 151568 - DNA, 794 bp, Homo sapiens
  misc_feature: GYAE6OF02F4T9M.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggccccagtctgccctgactcagcctgcctccgtgtcctgggttctccgtggacagtcgactcaacctatcctcctgcctacgtcggaaacccaccactcggacgttgcgttaggttaataaatctctcctctggtatacaactaacacccagaccaaacgaccccaagcactactattactgtactgtactaagtaacgtccggttaccgtttacggttacggggtttacctaacgttccgttcttcttcgtcggtacttaccgaacgttcgtcgggtaaccgtaccggacccgggttacccccttccccgtaacggtaaacccctaccgtttcccgttaccggttaccggggtacccgtcccggtaaccgggttaccgtaaacgggaaacggtaaccggggtacggttaccgttaagttaacttttaacgttaccgtgaccctaccgtaccttaacgtaagttaacgttacggaaacggtccgtaacgaccgtacgtacctaaccgtttccggttaacgggggtttaccgggacggggtaaccgggaaccgtaacggtcccggtaaccggttaccggtacccgttagggaacccgtaccggacccggtaccggtcccgtacccccggtcccccggttaaggttcccccg

SEQ ID NO: 151569 - DNA, 720 bp, Homo sapiens
  misc_feature: GYAE6OF02JA3OX.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcacgtcggaacccacctacgtgacgttcgcttaggttaactaaatacttctctcctggtactacaaacaactaccgaggacaaacgacccccaaagtacatactaatttagtagtatagtactaataacgtccggtaccgttcgtaagggtttaccaacgtccgtacttccttcgtcggtacctactaacggttcgcgtacgaccgtaaccggtccctacccgtacgtaacccgtacttaccgttccggtcggtaccctacccggacggtacgtaacggaaacggtacggacggttaccgttagtaacttttaacgttacgtcgtacacgtcctagacttaacgtacgaacggtcaacgcgtaacgaccttcgtaacgttcggggtttacgggaccgggtaccggaacggtaacgttacccggtacggttaacccgttaaccggttacggaccgtaccgtaaccgggaaccggttcccgtccccggttaccccggtcggtttaaccccg

SEQ ID NO: 151570 - DNA, 625 bp, Homo sapiens
  misc_feature: GYAE6OF02HO549.7.5.A05.1.454.CMB.1.raw
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcacgagggtcgtgggcccagtctgccctgactcagcctgcccttccgtcgtctgggtcctccgtggacctagtcggattccacccattcctccgtgacacgtcggaaaccctaccacgtagtaccgttgtccgttaggttaactaaaattcgtcctctacccgtaggtataccgaaacgtaacctnatnactcagctagctgtacgntcgccngtacntacgtcacgtacgactagtacgtcgatacgacgtagaccagttagacagtacgtacgtacgtacgtacgtacgtacgtacgacgtacgtacgtacgtacgacgtacgtaacgtacgtacgtaacgtagtacgtactacgtacgacgtacgtaacgacgtacgtacggttactacgtacgacgtaacgtacgtacgtaacgaagtactacgtaacgtacgtactactacgtacgacgtaacgtacgacgtacgtacgacgacgtactacgtacgaacg

SEQ ID NO: 151571 - DNA, 661 bp, Homo sapiens
  misc_feature: GYAE6OF02GOOOO.7.5.A05.1.454.CMB.1.raw
  modified_base (239)..(239): a, c, t, g, unknown or other
  misc_feature (239)..(239): n is a, c, g, or t
  modified_base (600)..(600): a, c, t, g, unknown or other
  misc_feature (600)..(600): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtcctctggacagtcgatcaccatcctctgcacgtcgaaccaccactgacgttcgntaggttaataaatctctcttcgtgtatacaaacaactacccgagaccaaacgacccaaagtacatactattatgattcgtactataacgttccggtacctttacggtacggtttactaagtccgtacttcgtccgtacggtacctaacgtaacgttcgtacgggaccgtaccgtacccggtccctacccgtacggtaaccctagtccgttccgtacgggtaccctccggtaaggtcctaaggaacggtaccggacgtcggtaacgttaagtttaacttaccgtcgtacacgtaaccttcaagttactagacgtacgacgtcaacgtctacgtacggttaggtacggcggtaacggcgtacncggttcgaaccggtcgtacggtcaaccggtccgaagtcccggtacccgcccgttgtacccg

SEQ ID NO: 151572 - DNA, 647 bp, Homo sapiens
  misc_feature: GYAE6OF02HLL8I.7.5.A05.1.454.CMB.1.raw
  modified_base (322)..(322): a, c, t, g, unknown or other
  misc_feature (322)..(322): n is a, c, g, or t
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
  modified_base (482)..(482): a, c, t, g, unknown or other
  misc_feature (482)..(482): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggtcacagggtcgtgggcccagtctgccctgactcagcctgcctccgtgtctgggtctcctggacagtcgatcacatcctctgctacgtcggaacccactacgtgacgttgcgttagttaataatctctcgtccgtagtacacaacacgtaccacggaccaaaccgacccccaaagtcaagttacctagtttancgtacgtacgttataacgtacgtaccggtccgttacggtacgggtttacctagtcgtcttcgtcgtgcctactaggtctcggtacgacnccgtccctactacgaccctagtcctcggcgtccncgtacgctagacgtacgagtctaagtacttgaacgtntacgtacgtctaccgtaattacgaccgagtacgacgacgacctacgtaaccgtcggtttacgggttacgggacgggtaaccgtaccgtaaggtcccggtacgtaccggttaaccgacgttccgaacgtacccgacggtaccgtacccggtcgttacccgtaccgg

SEQ ID NO: 151573 - DNA, 603 bp, Homo sapiens
  misc_feature: GYAE6OF02F92GU.7.5.A05.1.454.CMB.1.raw
  modified_base (193)..(193): a, c, t, g, unknown or other
  misc_feature (193)..(193): n is a, c, g, or t
  modified_base (299)..(299): a, c, t, g, unknown or other
  misc_feature (299)..(299): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtctgggcccagtctgccctgactcagcctgcctccgtgtctgggtctcctggacngtcgatcaccatctctgcactggaaccaccactgacgttgctggttaataaatctctctcctggtatcaacaatacccagacaaacgccccaaagtcatcatttangatgtataataatccggtcttacgtagggttacaacgtcgtcttctctcgcctacacgtctaggcgacgaccgccctcccgtgacctatccgtcgtcggcctaccgaggactaggaagacggaggtactagtaactttacttactgacacggtctactactaactacgacgtacgacgtacagacctaacgtcggttaacgggttttcgggacgggtacgggtaaccgacgtacgtaccgtacccggttaccgtacgaccgtaccggccgaaccggtccgtccccgtccccgtacgttaccccg

SEQ ID NO: 151574 - DNA, 613 bp, Homo sapiens
  misc_feature: GYAE6OF02GNOPL.7.5.A05.1.454.CMB.1.raw
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcaggcacagggtcgtggcccagtctgccctgactcagcctgccctcgtgtcgtgggtctcctaggactagtcgatcaccatctctnccactggaacccaccatgtacgtcgcttaggtaataaatctctactcgtagtactacaactaactaccgagaaccaaccgaccctaagcatctattangtatcgtactaagtacgtcgtacttacggtacggttacacgttcgtcttcncgtacgtactacgtacgtcgtggaccgacgtacccggtcctaccgtacgacctatcccgtgtcggtacctccgacgtacgtacgacggacgtagtagtctaacgtttactacncgtagcctatacctaanacgtacgngtactagcgtacgactaccgttggttaaccgggttgggacccggagaactaccggtcgcggtacccgtacgagtacccgagtacccggtcgcggtaccccgtccgtagtaccc

SEQ ID NO: 151575 - DNA, 630 bp, Homo sapiens
  misc_feature: GYAE6OF02HTHY9.7.5.A05.1.454.CMB.1.raw
  modified_base (301)..(301): a, c, t, g, unknown or other
  misc_feature (301)..(301): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctctgcactggaaccaccactgacgttgcttaggttaataatatctctctgtatcaacaatacccagacaaacgaccccaaagtcaatctatttangatgtctaataactcggcctttagtacgggtttacaactcgcttctctcggtactactaagtcgtcggacgtacgacgtccctcctacgacctactctacgtcggcctaccagggtctacggaacgacggtacggcttacgtatttaactacgtcggatacgtctactaataactacgaaggtacgacgcgtacgaactaccggttacgtacggggttttcgggacgggtacggggaactaacggtacgtaccgggtacccgttaccggttaacggtccgtacggaacccgtaaccggtacccgtacccggtcccccgtacggttaccc

SEQ ID NO: 151576 - DNA, 726 bp, Homo sapiens
  misc_feature: GYAE6OF02IVIVV.7.5.A05.1.454.CMB.1.raw
  modified_base (194)..(194): a, c, t, g, unknown or other
  misc_feature (194)..(194): n is a, c, g, or t
  modified_base (211)..(212): a, c, t, g, unknown or other
  misc_feature (211)..(212): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcacgggcacagggtcgtgggcccagtctgccctgactcagcctgcctcgtgtcgtggtctccgtggacngtcgatcaccatctccnncacgacgaaccncactgtacgtgacgttagtaanaacttctcctactcgtgtactacaaactacgtaccgaagaccgaaaccgacccgtaaatctagttaccttaagtttagagtacgtcgttactaagttacgtcccggttaccgtttacgggttcgggtttacctacgttacggttcctttcggcgttcgtaccgtaccggttaagttccgggacggtaccgaccgtaccccggttccgtaccccgttacgaccctacctttcgtaccggttccgggtcccgtacggacggtacggtacggaaacggcggtacgtacgttagtactttacgtatcgtacgacgtctataagaaccgttacggacgtagacgagttaccgaccgttcgtaagggtttccgggtcgggtacgggtaccggaacgtaccggtaccggtaccgttaacggtaccggttactacccgtacggacccggtaccggtacccggtcccggtttacccgcccggttacccg

SEQ ID NO: 151577 - DNA, 709 bp, Homo sapiens
  misc_feature: GYAE6OF02HFO6L.7.5.A05.1.454.CMB.1.raw
  modified_base (208)..(208): a, c, t, g, unknown or other
  misc_feature (208)..(208): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcagggcacgagggtcgtgggcccagtctcgcctgactcagcctgcctccgtgtcgtgggtctcctggacagtcgactcaccntcctccgtgctacgtacggaaccaccctacgtgtaacggtcgtcgttaggtttaaactaaaattcgttaccttcctccgtacggtattaacaaacgtaactaccgacggaacaaacccgaccccgtaaacgtactactacttaacgtttatacgatagttactaataacgttccggtccgttacggttacgggtttacctaagtccgtcttccgtcgtacgtccaccgtaagttcgtacggactaccggtacgcccttccgacgtaccctactccgttccgcggtacctacggtacgtaccgtaaggtacggaccgtagggtccttagtaacgtttacgtactcgactacggtacactagtactacggagcgtagactacgcttaaccggtcgttacgggttcggacgggacggaacgtccgaactacccggtaccgtttacggagaacccggtaacgcccggaaacggttccccgtacccggttaccccgcccgttaacg

SEQ ID NO: 151578 - DNA, 589 bp, Homo sapiens
  misc_feature: GYAE6OF02IMQ95.7.5.A05.1.454.CMB.1.raw
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctctggtatcaacaactaccagcaaagccaccaaagtcatctatttatgatgtctataatcggccttcgtagggttccatcgcttctctgctccagtctggcgacacgcctccctcgacctatctcgtcggctccgnggctagaagacggaggctagtattattactgcncgctctatactacgacggacacgacacgtccacgttaccggttacgggttttccgggacggggtaaccgggaaccgtaacggtaccggtaccggtacccggttaccggtaacgggtaccgaacccgggacccggaacggtcccgtacccggtcccccggttacccggg

SEQ ID NO: 151579 - DNA, 788 bp, Homo sapiens
  misc_feature: GYAE6OF02I5PQN.7.5.A05.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
tcagcgtgtctctacacgaccggtgctcgatttagatagatagacaggggggggggtctcaggaggcagcgctctcggggacgtcctccaccatggcctgggctctgctattcctcaccctcctcactcagggcacagggtcgtgggcccagtctgccctgactcagcctcgcctccgtntcgtgggtctcgtggacngtcgatcaccatctcngcactcggaaccaccactcgacgttgtcttaggttaataaatctctctccgtagtatactaaacaactaccgaagacaaaccgaaccccaagtcatactaattgtagtattacgtacttaagtaaccgtcgtaccgtttacgggttacgggtttacctaacgtccgttacctttacgttccggtacggtacccttacgtaacggttccgtacgggaccgtaccgtaccccggtcccttacccgactaccgttaaccttcccggttacggtccgggtaccctaccgtaacgggtacgtaacgggaaacgggtacccgggtaggtacgtttaacggttaactttaacgttaccgtaggacccttaagttaaccctattaaacttaaccgtacggtacggaacgacgaactccgtaacttaaccggtttacgggtttacgggggttttccgggaaaccggggttacgggaacccgttacggtaccggtttacccggtaaccgggtcgggttacccgaccggttaaccggaacccggtaccgttcccggtacccccggtaccccggttagtaccccgg

SEQ ID NO: 151580 - DNA, 719 bp, Homo sapiens
  misc_feature: GYAE6OF02FZAMT.7.5.A05.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagcgtgtctctacacgaccggtgctcgatttagatagatagacaggggggggggtctcagggaggcagcgctctcgggacgtctccaccatggcctgggctctgctattcctcaccctcctcactcagggcacagggtcgtgggcccagtctgccctgactcagcctgcctccgtgtcgtggtctcctggacngtcgatcaccntcctctgcactcggaaccacactgtacgttgcttagttaataatntctctctagtactacaacactaccagaacaacgacccaagtcatctattgntatnttactatagtccgtcttcgtacggttacctatctcttctcgtcactcgtagtcgtgacgtaccgaccgtccctacccgtacgtacctctacgtccggtacggtcctaccggacgggtacgttaacgggaacggtaacggtaccgggttcttaacggtacgttttaaccgttaaccgtcggtaaccttccggttaccttacgtaacttaaccgtacggaccggttaccgaaccggtacgtaacccgtccgttaaacggtttcccggttaacgggggtttaccggtaaccggggaccggtaaaccgagggtttaccccggaccggtttacccgggtaacccggtttaccggtacggtacccggtacccgttaacccgggccccgtacccccggttacccccgtccggttaacccg

SEQ ID NO: 151581 - DNA, 868 bp, Homo sapiens
  misc_feature: GYAE6OF02FWF80.7.5.A05.1.454.CMB.1.raw
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcgatcaccatctcctgcactcggaaccaccacgtgacgtttgacttaggttaataaatctctactcctaggtatcaacaactaccagacaaacgccccaaagtcaatcatttatgatgtactataacgtcggtccttacgtacggggtttaccaagttcggtcctttaccgttcgttcgggtccttacccgtaaacggttcgtacgggtaccggtaccgacccgggtacccttaccccggttacgtaacccgtaacctttccgttaccggttcggggtaccctacccggtaacgggtccgttaagggtaaacggtaaccgggtaaccgggtaccggtttaacggttaaaccgtttttaacgttttaaacccgttggttaacccgtaacggttacccgtttaacctaaacgtttaaacctttaaaccgggtaccgggaaccggttaaccggaaccgtaacccggtaaccgtaaacccgtttaccggggttaacggggtttttacccggggggaacccggggtaaccgggggtaacccggtaaacgggtcccggttaaccgggtaacccccgggttacccggttaacggggtacccgaccgggttaacccccggttaaccgggtttaccccccggtaccccccggtttaccgggttaccccgttaaccccccgg

SEQ ID NO: 151582 - DNA, 795 bp, Homo sapiens
  misc_feature: GYAE6OF02GE34G.7.5.A05.1.454.CMB.1.raw
  modified_base (256)..(256): a, c, t, g, unknown or other
  misc_feature (256)..(256): n is a, c, g, or t
tcagcgtgtctctacacgaccggtgctcgatttagatagatagacagggggggggtctcgaggaggcagcgctcctcgggacgtctccaccatggcctgggctctgctattcctcaccctcctcactcagggcacagggtcgtgggcccagtctgccctgactcagcctgcctcgtgtctgggtctccgtggacagtcgatcaccatctcctgccacgtcggaacccaccactgacgttgacttggttaataaatntctctcgtgtatcaacaactaccagacaaacgcccccaaagtcatactatttacgtgtattcgtactataacgtccggtccgtttacgtacgggtttaccaagttccgtactttctccgtcggtcctaccgtaagttcgttaggacccgtaacgacccgggtcccttacccctacggtaacccttacttacccgttccggtcgggtcccgtacccggtacgggtaccgttaacgggaaaccgggtaacgacggggttccttaaggttaacgtttttaaccgttaacggtaccgtaccggtaactacccggttaacttaacgttaaaccgttaccggtaacgggacccgtaaggacccgtaaccgttaccgtaaccgggtttaaccggtttaacgggggtttaccgggaaccggggttacgggaaacccgtacggggtcccggttaaccggttacccgtaaccgggtttaaccgaccggtaacccggtacccggaaccggttcccggtaccccggttacccccgttaccggttaccccgg

SEQ ID NO: 151583 - DNA, 621 bp, Homo sapiens
  misc_feature: GYAE6OF02HQ9D0.7.5.A05.1.454.CMB.1.raw
  modified_base (294)..(294): a, c, t, g, unknown or other
  misc_feature (294)..(294): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctctgcactcggaacctacactgacgttgcttaggtataatatctctctggtatcaacataccaggacaacgcccaagtcatctatttanagtatcgtctaataactcggtccttacgtacgggtttacaattcgtcttcgtctggcttcgagttcgtaggcgacaccggtccctacccgtcgacctattcgtaccgtcgggtacccttccgaggtcctaggaacgacgtagaccgtgtaactagtttacgagctagtactcatttanaccgngtacagtacgacgaccgtacttaccggtaagggttttccgggaaccggtacgggacctaacggtcgtacggtacccggttctaacgggttcccaacgggtccccgtaaggtccccgtaccggtacccccggttagttaccccgg

SEQ ID NO: 151584 - DNA, 635 bp, Homo sapiens
  misc_feature: GYAE6OF02G476Q.7.5.A05.1.454.CMB.1.raw
  modified_base (312)..(312): a, c, t, g, unknown or other
  misc_feature (312)..(312): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctgggtctcctggacagtcatcaccatcctcctgctacgtcggaaccaccacgtgacgttgcttggtaataaatctcctctccgtgtatacaactaactacccgagaccaaaccgaccccaagtcactactattangtatgtactataacgtcgtaccttcggtagggttaccaatccgtcttcgtcgtcgactactagtcgtaggaccgacctacgtccctactacgacctattcctcgcggtcctcgagtcaggacgngacgtntaggtacttacttcgtcgtacacgtactatactaacgtacggacgtacgacgacgtaccgacttaaccggttcggttaacggggtttaccggacggggtaccggtaacctacggtcggtaaccggttacccgtacggtaccgtaccgtacccggaccgttaccggcccgtacccggttccccttagggtaccc

SEQ ID NO: 151585 - DNA, 661 bp, Homo sapiens
  misc_feature: GYAE6OF02HL1EJ.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactcggaacccaccactcgtacgttcgcttaggttaataatatctctcctgtatacaacaactaccagacaaacgaccccaaagtcatactatttatagtatcgttactaataacgtccggtccttacggtacgggtttacctaacgttcgtcttctcgtcggtcctacctaacgtcgtacggcgtaccgaccggtccctccctacgacctactcgtacgtcgggtcctccgacgtcgtagaacggacggacgtcgtagtactttaattacgtgactacgtcgtactaacttaactacgacggtacacgacgacgtacctaacgttacggttcgggtttaccgggacgggtacggaaccgtaacggtccgtaccggtaacccggttccgtaacggtacccgtaccggacccgtaacggtcccgtcccggtacccccgttccggtaaccc

SEQ ID NO: 151586 - DNA, 680 bp, Homo sapiens
  misc_feature: GYAE6OF02GPN3U.7.5.A05.1.454.CMB.1.raw
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
tcagcgtgtctctacacgaccggtgctcgatttagatagatagacaggggggggggtctcaggaggcagcgctctcgggacgtctccaccatggcctgggctctgctattcctccaccctcctcactcgagggcacgaggggtcgtcgggcccagtctgccctgactcagcctgccttccgtgtcgtcggtcctcgtggacagtcgatcaccatcctcgtgacacgtacgaaccacactgtacgtgcgttagttaataatactcctctcgtaggtactacaacaactaccgagaccaaacgacccctaagtccatactagttagtatatacgttataacgtaaccgtccggttaccgtttacggtaaccggggtttaccaagtccggtcttccgttcgtacggtacctacggtaacgtcgtacgggccgaccggccgtacccgtccctacgaccctctccgtacgtccggtctaccggagtcgtaacggaagtagggactcgtataactttagttacgtacgtcgtactacgtactaacgttanaaccgngacccgtanacgaccgtacaacgttacggttacgggtacgggaaccggtagaccgtaaggccggttaacgaccggtcgttaaccggtcgaacccgggtcaacccggttcaccccggttcctacgtacccg

SEQ ID NO: 151587 - DNA, 678 bp, Homo sapiens
  misc_feature: GYAE6OF02JNOX1.7.5.A05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
tcagcgtgtctctacacgaccggtgctcgatttagatagatagacagggggggggtcgtcaggaggcagcgctctcgggacgtctccaccatggcctgggctctgctattcctcaccctcctcactcagggcacgagggtcgtgggccctagtctagccctgactcagtcctgcctccgtgtctgggtctccgtggacngcgatcacntcncngcatcgaaccncatgacttgacttgtaataatntctctctgacactaactaacacctacgacaacgacccaacgtacgatctaacttattgactgttacgtaacttaactacggtccttcgtacgggttaccgtaaagtccncgtttacctcgtcgtactccgtaacggtctcggaacgtcgaccgtcccgtccnccttaccgtaaccgttcttaccggtccgtacgtccggtaacgtcgtacgtacgacggtacgtcgtacgtattaacgttaacgtacgtcgtacgacgttactacgtataaccggtacgaccgtacgaaacgccgttaactaccggttattaccggggtttacgggtaccgggaccggtaaaccggtcggtaccggtaccttaaccgggtccgttaccggtacggacccgtacgtaaccggttacccgacccgttacccggcccgttaccgg

SEQ ID NO: 151588 - DNA, 680 bp, Homo sapiens
  misc_feature: GYAE6OF02GUKKS.7.5.A05.1.454.CMB.1.raw
  modified_base (312)..(312): a, c, t, g, unknown or other
  misc_feature (312)..(312): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccacgtcgtacgttgtctggttaataaatatctctctgtatacaacaactaccaggacaaacgaccccaagtcatctattatgtatntactataacgtcggtccttcggtacgggtttacctactcgtcttctcgtcgtctacgtacgtcgtggccgtacgaccggtccctacccgtcgaccctatccttacggtcgggtacccttccggacggttcgtaaacggaaggtaccggaggtaccttagtactttacgttactaggctacgtactacgaattactaacggacgactacgcgtacgaccctacgttaccgggtttaagggttcccggggacggggtaaccggacccggtaacgggtaccggttacccggaaccggttcccggttaacggtaccgtacccggaccgggtaacgggtcccggtaccccggtcccccggtaccggttacccg

SEQ ID NO: 151589 - DNA, 843 bp, Homo sapiens
  misc_feature: GYAE6OF02IMA4V.7.5.A05.1.454.CMB.1.raw
  modified_base (267)..(267): a, c, t, g, unknown or other
  misc_feature (267)..(267): n is a, c, g, or t
  modified_base (349)..(349): a, c, t, g, unknown or other
  misc_feature (349)..(349): n is a, c, g, or t
tcagcgtgtctctacacgaccggtgctcgatttagatagatagacaggggggggggtctcaggaggcagcgctctcgggacgtctccaccatggcctgggctctgctattcctcacccctcctcactcagggctacgagggtcgtgggcccagtctcgccctgactcgacgcctgcctccgtgtcgtgggtctcctggactagtcgactcacctattcctccgtgctacgtacggaacccactacgtgacgttgacgttagttaaanaattctctcctcgtaggtacactaacaacgtacccgaagtacccgaaaccgaccccaaagtccattacgtatttatgtaatntaacttattacgtcgttaccgttacggttaacgggtttaccacgtcgttaccttacgtcgttccggccttaaccgtagttaccggtacggtaccgaccgttaccgtaccctccctaccggtaccttcgttcccgtacggtccggtacccgtacggtacggtaaccgtaacgggaactaaccgggtacgtacttaacggtttaactttacgttacgtacgaccgttacgtaccgttaactaacgtaacgtaaccgtaaacgggtacccgtaaccggtaacccgtacgttaaaccccgttaacgggttttaccggttaaccggggggtttacccggggaaagggaacccccgggttaaaagtacccgggtttaacccgtaacccggggtttaaccccgtaacggggttttacccggaaacccggttcccgaaacccggggtttaaccgaccccccgttttaccccggggcccccggtttaaaccggttacccccgg

SEQ ID NO: 151590 - DNA, 748 bp, Homo sapiens
  misc_feature: GYAE6OF02HEB9W.7.5.A05.1.454.CMB.1.raw
  modified_base (257)..(257): a, c, t, g, unknown or other
  misc_feature (257)..(257): n is a, c, g, or t
tcagcgtgtctctacacgaccggtgctcgatttagatagatagacgaggggggggggtctcaggaggcagcgctctcgggacgtctccaccatggcctgggctctgctattcctccaccctcctcactcagggcacagggtcgtgggcccagtctgccctgactcagcctgcctccgtgtctgggtctcctggacagtcgatcaccatcctcctgctactcggaacccaccactggacgttgcttaggttaataatntctctcctgtatacaacaactaccgacggacaaacgaccccaaagtcatactattatgatacgtactaatagtccggtcttcgtacgggtttcctaagtcgtcttctcgtcggtacctaccgtaacgtcgtacggaccggaccgtacccggtccctccccgtacgaccctacgttcccgttaccggtcgggtccctaccggtacgggtacgtacggaacggtaccggtacggtacgttagttaacgtttaacgttaccgtcggaccgtacgtacctactaagttaacgtaaccgacgggtaccacggaccgtacgtaccgtaccgttaccgggtttaaccggggtttacccgggaccgggggtaccgggtaaccgtaccgggtacccggtacccggttaacccggttaacccggttacggtacccggtaacccggtacccggtaaccgggtacccgtccccggttacccccccggttacggttacccccgg

SEQ ID NO: 151591 - DNA, 851 bp, Homo sapiens
  misc_feature: GYAE6OF02F0T5Y.7.5.A05.1.454.CMB.1.raw
  modified_base (306)..(306): a, c, t, g, unknown or other
  misc_feature (306)..(306): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgcttggttaataaatatctctcctggtatcaacaatacccaggacaaacgacccccaaagtcatactatttancgtatgttactattaacgtccggtccttcgtacggggtttaccaatccgtccttcgtctcggtcctaccgtaacgttcgtcgggtaccgaaccgtacccggggtcccctttacccccgtacgaaccccttacgttacccgttaccggttaccggggtccctttaccccggaacgggtacccgttaacgggtaaaacgggaacccgggtaaccggggttaccgttaacgggtaaaccgtttttaaaccgtttaaccggttcggtacccgtaacgggtaccctttaaccgtaaccgttaaacgttaaacccggaacgggtaccaacggtaccgaaccgtacccgttaacccgtttaccgggttaacggggttttttacccgggggaacggggtaaccggggtaacccgtaaccgggttaacccggtaacccgggttaaccccggtttaacccggtttaacgggttaccccgtaacccggttaccccgggaaaaccgggttccccggttaccccgggttacccccccggttacccgggttaaccccgg

SEQ ID NO: 151592 - DNA, 904 bp, Homo sapiens
  misc_feature: GYAE6OF02GG1WN.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgccactggaaccaccactgtacgttgccttaggtttaataaaactacgtcttccttccgttacggttaacttaccaaaacctaaaaccttaaacccccgaaacgggtacccgaaaaaaccggacccccccctaaaaaaggttaccctaacttacccgttaacgtttttaatacgggttaactttacggtttaacctaaagtttaaaccgttccgggtaccccgttttaaccggtacggggggtttttaccccaaaagtttcccggttaccttttccgtttaccggtttacgggtacccgtttaccgtaaacggtttccggtttacggggacccgtaaccggtaacccgggtccccgttacccccgttaccgtaacccgtaaccgtttccgttaccggtcgggtacccgttacccggacgggtaccgtaacggtaaacgggtaacgggtacgggtaccgttaggtaacgtttaacgtttaacctcggacctacgtactacgtaactaacgttaaccgacgggaccgagaccgtacgaaccgttacgttaccggttaagggtttccggggaaccgggttacgggtaacccgtaacgggtaccggtaccggtacccggtaacccggttaccgggtaaccggtaccggtacccggaacggttccccgtaccggtacccccggttaccgggtaacccc

SEQ ID NO: 151593 - DNA, 870 bp, Homo sapiens
  misc_feature: GYAE6OF02IIKP3.7.5.A05.1.454.CMB.1.raw
  modified_base (171)..(171): a, c, t, g, unknown or other
  misc_feature (171)..(171): n is a, c, g, or t
tcagcgtgtctctacacgaccggtgctcgatttagatagatagacagggggggggggtctcaggaggcagcgctctcgggacgtctccaccatggcctgggctctgctattcctcaccctcctcactcagggcacaggggtcgtgggcccagtctgccctgactcagcctncctccgtgtctgggtctcctggacagtcgatcaccattcctcctgacactcggaaccaccactcgacgttcgtacgttaggttaaataaacttactccttccttccgtaggtaactaccaaaacgtaaacctaacccgaaggaacctaaaccgaccccctaaaaggtcctataccgtaatttaactagtaacgttcgttaactaacttaacgttaccggtacccgtttacggttaaccggggtttacctaacgttccgtacgttcgttacgtcgacttaccgtaaggtccgtagggtaccgacgtaaccggtcccttacccgtacgtaacctacgtaccgttcggtacgggtacccttaaccggacgggttacgtaaacggtaacggtaaccgggtaccggtacggtttacgttaacgtttaaacgtttacgggtaacggtacccgtaaggtcccgtttaaactaaccgtttaacgaaaacccgtcggggtaaaccctacggttaacccgtaacgaccgtttaaaccggttacggtttaaaccgggggttttacgggggaacccgggaacggggtaacccgtaaccggtccgttaaaccgggtacccgttaacccgggtaaccggtacccgtaaccggggtaaccccgaaaccggggtttacggaccccccggttaaccccgggttcgttaacccccgg

SEQ ID NO: 151594 - DNA, 642 bp, Homo sapiens
  misc_feature: GYAE6OF02I7Q9Y.7.5.A05.1.454.CMB.1.raw
  modified_base (129)..(129): a, c, t, g, unknown or other
  misc_feature (129)..(129): n is a, c, g, or t
tcagcgtgtctctacacgaccggtgctcgatttagatagatagacagggggggggtctcaggaggcagcgctctcgggacgtctccaccatgcctgggctctgctattcctcaccctcctcactcaggnacagggtcgtgggcccagtctgccctgactcgagcctgcctccgtgtctgggtcctccgtggacagtcgatcaccatcctcctgacactacggaacccaccgactcggtaccgttgacttaggttaataatatcctctcgtgtactacaacaacctaccgacgaaccaaaccgtaccccgtaagtactatacttattatagtatgtactaacgtacgtccgtcgttacggttacggttacctacgtccgttcttctcgtacgtctaccgtacgtcgtacggacgaccgtccgtccctccgtacgtacctcgtcctcgtcgcctaccgagtctacgaacggagtagtctagttacttacttacgtcgacgtactactactactacgtacgagacgagtacgacgtacctagttacggttagggttcgggacggtacggacgtacggtcgtaccggtaccgtaccgtacgtacccgtaccggtaccgtaccgtcccgtacccgtcccgtacgtcc

SEQ ID NO: 151595 - DNA, 576 bp, Homo sapiens
  misc_feature: GYAE6OF02G86EH.7.5.A05.1.454.CMB.1.raw
  modified_base (251)..(251): a, c, t, g, unknown or other
  misc_feature (251)..(251): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctcctgcactggaacccaccactgacgttgctggttaactaaatntcctctcctgtatcaacaactacccagcaaacgccccaaagtcactcattatgatgtactataactcggtccttcgtacgggttccaatcgtcttctctggctccaagtctggacgacaccggccctccctcgaccctactcgtcgtcgggtctccgacgcgtgaagacgacggactgtacttattactcgactagctcataactacgagcagcacgacactcgtacggtttcgggacggtacgggtaccaacggtcgtacggtaccgttccgtacggtaccgaccggacccgtacggtccctcccggtaccccgtcggtacccg

SEQ ID NO: 151596 - DNA, 799 bp, Homo sapiens
  misc_feature: GYAE6OF02J1EPV.7.5.A05.1.454.CMB.1.raw
tcagcgtgtctctacacgaccggtgctcgatttagatagatagacagggggggggtctcaggaggcagcgctctcgggacgtctccaccatggccgtgggctctgctattcctcaccctcctcactcagggcacagggtcgtggcccagtctcgccctgactcgagtcctcgcctccgtgtccgttgggtcctccgtcggactacggtcgtataccgacctagttccttccgtgtacctaacgtcggaaacccacctacgtcgtaccgttggtcgttaagttaataaaacgtcttctctaccgttagtactacaaacctaacctacccgaagaccgaaaacccgaccccctaaagtcctaattactaacttttagagttgtacgttaacttaacgtaaccggttacccggttaccgttttacccgggttacgggttttaccctaacggttaccgttccgtttaccgtccggttacgtaccttaccggttaagttcccgtacgggaccaccggtacccgtacccttccccggttacgacccttacgttccgtcggtaccgtccgtacggtacgtaccggaaacgacggtaacgacggtctagtttaaccgttagttacgtcgaccgttacaccgtataacctagacgacgtagacgtacgtcgaaccgtacgttaccggttacggggttaccgggtaacgggaaccggtacgtaacggtcgtaaccgtacggttacccggtacgtacccggtaccgggtaccgtacccggcccggtaaccccgtcccgtaccgttacccg

SEQ ID NO: 151597 - DNA, 823 bp, Homo sapiens
  misc_feature: GYAE6OF02FTLRU.7.5.A05.1.454.CMB.1.raw
  modified_base (305)..(305): a, c, t, g, unknown or other
  misc_feature (305)..(305): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcacatctctgcactgaaccaccactgtacgttgcttaggttaataatactctctcctggtatacaacaactaccgaggaccaaacgcccaagtcatctatttangtattgtactattaacgtccggtccttacgttacgggtttccaagttccggtcttccgtcgttcggtccttacctaacggttccgtacggacgaccgcccgggtcccttcccgtacgtacccgtaacgttcccgttcggtccgggtacccgtacccggtacgggtaccgttaacgggaaaccgggtaccgggttaaccgggtacgttacggttaaaccgtttttaccggtttaaccgttacggtacccgtaacgggtcccttacgttaaaccggttaaaccgttaaccgggaacgggtaaccggtacccggtaaccgtaccgttaaccgttaacccggtttaaccgggtttaaccggggggttttacccgggggaccggggtaaacccgggtaaccggtaaccgggttccgggtaaccccgggttaccccggttaaccggtaacccgggttacccgtacccggtacccgggtaacccgggttcccgtacccccggttcccccggtacgttaccccggg

SEQ ID NO: 151598 - DNA, 916 bp, Homo sapiens
  misc_feature: GYAE6OF02H6EPO.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctctcactcgagggcacgagggtcgtgggcccagtctcgccctgactcacgcctcgcctccgtgtctgggtcctcctggacagtcgatacacctactcctcctcgcctacgtacggaacccacacgtgtacgttgtacgttaggttaataatactcttcctaccgttagtactaccaactaaccgtaccgaacgaccgaaaacccgtaccccctaaaagtacctaactaccttaacgttttagtacgttaattacgttacctttaacgttaaccgttcccggttaccgtttaaccgggtaccgggttttaacctaacggtttccgttcccgttttaccgtaccggtttacccggttacccgttaaccgttaacggttcccggtaccgggaacccgtacccggtacccccggttccccttaacccggttacccggtaccctaccgttttacccgggttaccggtaccgggttacccggtaccgggtaccggtaacggtaaccgggaaacgggtaaccggggtacggttacggttacgtttaaggtttacccgttaacgtcgggttacgtacccggttactaaccgttaaacggttaacgttaaccgggtacggtaacccggtacgtaccggtaaccgtacccgttaacggtcggttttaaccggggttaccggggaccggttaccgggtaaccggtaaccggtccggttacccggttaaaccggtccgttaaccgggtaccggtaccggtaaccccgtccggtaccccggtttacccgtacccccggttcgtaacccccgg

SEQ ID NO: 151599 - DNA, 700 bp, Homo sapiens
  misc_feature: GYAE6OF02IOOY5.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctgggtcctccgtggacagtcgatccaccatcctctgctactggaacccacactgtacgttgcttaggttaataaatctctctctgtacacaacaactaccaggacaaacgaccccaaagtcactctatttagctatatactaatacgtcgtcctacgtacgggttaccaagtccgtacttctacgtcggtacctaccgtaagttcgtcggaccaccggaccgtaccgtccctacgtacccacttcgtcgtaccggtccgtaccgacggtctaggaacgtacgacggtacttagtaatttacgttacgtacgacgacgtctacctaatactaacggtacgacgtaacgacctacgacccgttacgttacggttaccggggttttacgggaccggggtaacgtacccgtaaacgggtcccggtaacgtacccccgggttaacgttaccgggtaacccgtaacccggttaaccccggtaacggttaccccggttaccccggtacccccgttaccggttaaccccgg

SEQ ID NO: 151600 - DNA, 667 bp, Homo sapiens
  misc_feature: GYAE6OF02F9TPN.7.5.A05.1.454.CMB.1.raw
  modified_base (195)..(195): a, c, t, g, unknown or other
  misc_feature (195)..(195): n is a, c, g, or t
  modified_base (318)..(318): a, c, t, g, unknown or other
  misc_feature (318)..(318): n is a, c, g, or t
tcagcgtgtctctacacgaccggtgctcgatttagatagatagacgagggggggggtctcaggaggcagcgctctcgggacgtctccaccatggcctgggctctgctattcctccaccctcctcactcagggcacagggtcgtgggcccagtctgccctgactcagcctgcctcgtgtctgggtctccgtggacngtcgatcaccatctcctgccacgtcggaacccacctactcgacgttgcttaggttaataaatctctcctccgtgtactacaacaactaccaggaccaaacgcccccaaagtcaactctattangtattgtactaataactcgtcttcgtaacgggtttcaattcgtacttcgtcgttcgcctacgaacgttcgtacggacgtaccgaccgtccctcccgtacgacctactttcgccgtcggtcctaccgacggtcgtacggaaacggaacggacgtacgttagtacgtttacttacgttcggtactacgtcttacgtaacttacgtacgacgacgagacgcgacgtacgttcggttacgggttacgggtaccgggacggacgtaacggtcgtaccggttacccgtaccggttaccggtaccgaaccggtacccggtaaccggccgttaccccggtacccgttaccgtacccg

SEQ ID NO: 151601 - DNA, 764 bp, Homo sapiens
  misc_feature: GYAE6OF02IIH4O.7.5.A05.1.454.CMB.1.raw
tcagcgtgtctctacacgaccggtgctcgatttagatagatagacgagggggggggtctcaggaggcagcgctctcgggacgtctccaccatggcctgggctctgctattcctcaccctcctcactcagggctacgagggtcgtgggcccagtctcgccctgactcacgcctgcctccggtgtcctgggtctccgtggacagtcgactcacctattcctctcgactagtcgggaaccctaccactggtacgttcgcttaggttaaataaactagttctccttccgttcggtaatacgaaacctaaactacccgaacggtaaccgaaaccgtaaccccccgaaagtcctaactacgtaacgttaatagacgtttacgtactaactaagttccggtaccgttacgttacggggtttaccaacgttccgtcgtttactccgtacggtacgtactaacggttccgtacgggtaccgaaccgtccggtaccctccgtaccgacttactccgtcggtcggtacccgtcgtaacggtcgtaacggtacggaaccgtacggtcgtaacttacgttacgttaacgtcggacctcggactacctaagttaacgaacgtagtaccgacgtaccggacgttacgaaccgtttcggttaaccgggtttccgggaacgggaaccgggtacgaaccggtcggtaacccggttcggtaaccgtacggtaccgtacccgtacccgggtaccggccccgtaacccgtccccggttgtacccg

SEQ ID NO: 151602 - DNA, 773 bp, Homo sapiens
  misc_feature: GYAE6OF02F8DR9.7.5.A05.1.454.CMB.1.raw
  modified_base (566)..(566): a, c, t, g, unknown or other
  misc_feature (566)..(566): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtcgggcccagtctgccctgactcacgcctgccctcgtgttcgtcgggtctccgtaggacagtcgatcaccatcctcctgcaacgtcggaacccacctacgtcgtacggttcgacgttaagggtttaaataaacttacgttccttccttaccgttaggtaactactaaaaccaacgttaaccccgaggaacccgaaaacccgaacccccctaaaagtacctaattaccttaacgttttaagtagttacttacgttaacgttaacgttaaccgttaccggttaccgtttaccggttaaccgggggttttaccctaaacgttccggttacctttccggttccgtcgggtacctacgtaacggttcgtacgggccgaccgtaccgtccctaccgtcgacctcgtcgtcggttaccggtccacgtacggngtacggaacggacggtacggtactaaggtattactacgtactcgtacgtactactaacgtaacgtacggaggtctaacgcgtacgtaccttacggttacggttacgggttaccgggacggacggtaccgtacgtcggtacccggtaccgtacgtaccgggtaccaaccgggtaccgaccgtcccgtacccgtcccggtacccgtccg

SEQ ID NO: 151603 - DNA, 629 bp, Homo sapiens
  misc_feature: GYAE6OF02F7MWA.7.5.A05.1.454.CMB.1.raw
  modified_base (263)..(263): a, c, t, g, unknown or other
  misc_feature (263)..(263): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcaggcacagggtcgtggcccagtctgccctgctcagcctgcctccgtgtcgtgggtcctcctggactagtcgatcacctatcctcctgctacgtcggaacccaccacgtcggtacgttgacttaggttaataactntcctctctaggtactacaacaactaccgacgacaacgaccccctaaagtctatactattagtgattgtacttattaacggtccgttaccgttacggttaccgggtttactaacgtcctacgttctcgtcggactccacgttcgtggacgaccgaccgtcctccgtacgacctacgtcgtcgtcggctccgacgtctaggacgacgacgtactagtactttagtacgtgacgtntcctntaatactagacgcacgcgacgctacgtacggttacgggtttcggacggtacggacgtacggtccgtaccggtaccggtcgtacgacgtaccgcgggggtacctaccggtcccgtacccgtcgtacccg

SEQ ID NO: 151604 - DNA, 719 bp, Homo sapiens
  misc_feature: GYAE6OF02IMGBM.7.5.A05.1.454.CMB.1.raw
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtggcccagtctgccctgactcagcctgcctccgtgtctgggtctccgtaggactagtcgatcaacntctcctgcacgtacggaaccacactgacgtgtacgttaggttaataactatctctacgtgtactacaacaactaccgagaacaaccgaccctaaagacattactatttacngtattacgtactaagtaacgtccgttaccgttacggtaacgggtttaccaagttccgtactttctcggtacgtaccgtacgttaacgtcgtacggaccgaaccgtaccgtccctacctacggtaacctacgttcgtaccggtacggtccgtaccggtacgtccggttaagaaacgtccggtaacgtacgttagttaacgtttaacttaaccgtgaccgtaacggtccttaaatacggtaacttaacgggacgttaccgaacgtaccggtaacctaccgtacgtttaccggtaacgggttttccggggaacggaccgggtaaccgtaaggccgttaaccggtacccgttcgtaacgtaccgaaccgtccggaccgtacccggcccgttaccccgtgttaacccg

SEQ ID NO: 151605 - DNA, 691 bp, Homo sapiens
  misc_feature: GYAE6OF02GD11F.7.5.A05.1.454.CMB.1.raw
  modified_base (310)..(310): a, c, t, g, unknown or other
  misc_feature (310)..(310): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggactagtcgatcaccatcctcctgcactggaacccaccactgacgttgcttaggttaataaatactctctctgtactacaactaactaccagaccaaacaccccaaagtcatctattatntatgtactataacgtccgtacgttcgtacgggttctaacgtccgtacttctccgtacggtcctaccgtacgttacgtcggacggaccgtaccggtccctccgtacgtaccctctcttcggtcgggtcctccgacggtcgtaggaaccggtacggaacggtgtacgtaacgtttacgttacgtaccgtctaacgtcctaactaactaacgtacgacggacgacgtctaacgtaccttacggtacgttacggggttaccgggaccgggacgggtaccgtaaggtcccgttaacggtacccggttacccgtaaggggttaccctaacccgggtaccggttaacccgggtaccctccccgggtaccccggttcccggttaacccc

SEQ ID NO: 151606 - DNA, 859 bp, Homo sapiens
  misc_feature: GYAE6OF02JUF0R.7.5.A05.1.454.CMB.1.raw
  modified_base (135)..(135): a, c, t, g, unknown or other
  misc_feature (135)..(135): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcaggcacngggtaaaaaaaaaaaacggtcgggccacgtctcgtcctcgactcacgcctcgcctccgtcgtcgtgggtctccgtcggacacggtcgtacgtaccacctactcctccgtcgtacacgtacggaaccaccacgtacgtacggttggtcgttaggttaactaaactacttaccttcttccgttacggttaactaccaaacgtaactaacccgaacggaacaaaccgaaccccgtaaacgtacctactactaacttaattacgaacttacgtacgttaacttacgttaccgtaccgttacggttacgggtttaaccgtaacgttaccggttacttcgttaccgtacgtccgtaccgtaacgttacggtacggtaccggaaccgtaccggtacctacccgtaccgtaacctacgttccttaccggtaccgggtacccttacccggtaacggccggttaaacgggaacgtaaccgggaggttaccggttacgttaaacgttttaacttaccggaccggtacgtaccgttaaccgttataccgttaaacgacggacgtaacgaacgccgtagggacccttaacggttccggggttaagggttccggggtaaccgggtaacgggacccgtaaagtacccggttaccgggttaccgttaaccggttagggtaacccaacccgggtaaccggaacggtttcccgaaccccgggttaccccgttaaccggtccg

SEQ ID NO: 151607 - DNA, 763 bp, Homo sapiens
  misc_feature: GYAE6OF02HLS05.7.5.A05.1.454.CMB.1.raw
  modified_base (134)..(134): a, c, t, g, unknown or other
  misc_feature (134)..(134): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcaggcacgngggtcgtgggcccagtctagccctgactcagcctgcctcgtgtctgggtcctccgtggacagtcgatcaccatcctctgcacgtggaacccacgtacgtgtacgttgacttaggttaataaacgttctcctctccgtagtactcaacaactaccagacaaaccgacccctaagtacactacgtaatttatgtatcgttactaacgtacgttccggtccttacggtacgggttccaagtcgtactttcgcgtcggctacgtagttcgtggacgacgtaccgtcccttccgtacgaccctaagttccgttacggtccgggtaccctccggaacgggtaccgttaacgggaaacggtaaccggtacgggttacgtttacgttaacgttttacgtttaccgtacggtacgtacggtaaccttacgtaactttaacgtaaccggtcggaaccgtaggaaccgtacggttacccgtaacgggtttaccggttacggggttttaacgggaccggggttaaccgggaaccgtaacgggttccgttaccgggttaacccgttacggttaccggtaccgtaaccggtacccggtaacggttccccggttacccggttaccccgggtaccgttaccccgg

SEQ ID NO: 151608 - DNA, 785 bp, Homo sapiens
  misc_feature: GYAE6OF02GB2O6.7.5.A05.1.454.CMB.1.raw
  modified_base (169)..(169): a, c, t, g, unknown or other
  misc_feature (169)..(169): n is a, c, g, or t
tcagcgtgtctctacacgaccggtgctcgatttagatagatagacgagggggggggtctcaggaggcagcgctctcgggacgtctccaccagtggcctgggctctgctattcctcaccctcctcactcagggcacagggtcgtgggcccagtctgccctgactcagtcngcctcgtgtcgtgggtctccgtggacaggtcgactccacactctccgtgcactacggaacccacaacgtcgacgttcgcgttaggttaaataaagtcttccttccgttaccgtaggtactactaaactaaacctaccgaaggaccaaaacccgacccccgtaaaagtcctaacttacttaagtttaacgtacgtattacggttaacctaagttaacgtcccggtaccgtttacgggtaacgggtttacccaacgttccttaccttctccgtacgggtaccttaccaagttccgtacggcccgtaaccggaccgggttccctacccggtataaccccgtgtttaccctacgggtttaccggcccttaaccgggacgggttaccgtaaacgggaaaccggtacgggtaacggtaccgttaggttaaattttcgttaacgtaacgtcgtaaacgtccttaaccgtataaagccggtaaacgcgaacgtaccgagtacccgtaacgttccggtacggggtttcgggacgggtaacggaccgtacgtaccgggtacgtacccgtaacggtagtcccgtaacgacccgtacggtacccggacccgttaccccgtgtaacccg

SEQ ID NO: 151609 - DNA, 744 bp, Homo sapiens
  misc_feature: GYAE6OF02GSVQD.7.5.A05.1.454.CMB.1.raw
  modified_base (150)..(150): a, c, t, g, unknown or other
  misc_feature (150)..(150): n is a, c, g, or t
  modified_base (615)..(615): a, c, t, g, unknown or other
  misc_feature (615)..(615): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcgaggcacgagggtctgggcccnggtctcgcctgacctcgacgcctcgcctccgtggtactgggtcctccgtaggacctagtcgatccacactcctctgctacgtacgaacctaccacgtgtacgttcgacttaaggttaactaaatctctactcgttagtaactaccaaactaactaaccgaggtaaccaaaccgacccgtaaagtactaacttactaattacgtgtaactcgtaataacgttaacgccggtacgttaccgggttaacgttaccaacgttccggtacttaccgtcgtaaggtcctaacgtagttcggtaccggacctacgtaacccgtccaccgttaacgaaccttacgtcgtaacggtccggttaccgtaccgtcggtaacgtacggaaacgtaaccggtacgttaattaccggttaacttaagttccgtaaggtccaaggttcctaacgtaataccgtagtacgacgtaccgtanaaccgtccgtaacgttacggtaacgggttccgggaaacggaccggtaaacgtacggtcgttaacccgacccgggttcacggttaccaacgcccggttaacgccgttaccccggttccggaacgttcccg

SEQ ID NO: 151610 - DNA, 755 bp, Homo sapiens
  misc_feature: GYAE6OF02HZ6BC.7.5.A05.1.454.CMB.1.raw
  modified_base (262)..(262): a, c, t, g, unknown or other
  misc_feature (262)..(262): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacgagggtcgtgggcccagtctgcctgactctagcctgcctcgtgtctgggtctccgtggacgagtcgagtcactatctccgtgcgtactacggaaccctaccactagcgttgcttaggttaataaatntctctcctaggtaatacaactaactacctaggacaaacgcccccgtaaagtctactactaactttagtagtagtgtacgtaactaacgttccggtacctttacggtaacgggtttaccaacttccgtactttcgtaccgtcgtactacgaacgtcgtacgacgacgtaccgcccttaccgtacgtaaccctagtcccttcggtacggggtaccctaccgtaaggggtacctaaaggggaaaccgtaaccgggtacgggttaacctaagttaaacgtttaaccgttaaacgtcggacgtaaaccgtcgttaacaacggtttaacgtaaccgtacgggttcaaacggggttaccaacgtaccgttaaacgtacgggtttagggtttacccgggaaccgggaacgtaacgaccggtaacgtaccgtaccggtaccgttaagggtacccgaccggtaaccgtaaccggtccgtacccgtccccgggtacgttacccg

SEQ ID NO: 151611 - DNA, 763 bp, Homo sapiens
  misc_feature: GYAE6OF02GRQKM.7.5.A05.1.454.CMB.1.raw
tcagcgtgtctctacacgaccggtgctcgatttagatagatagacagggggggggtctcaggaggcagcgctctcgggacgtctccacatggcctgggctctgctattcctcacccttcctcactcgagggcacgagggtcgtgggcccagtctcgccctgactacagcctgcctccgtgtcgtgggtctctggacagtcgactcaacctatctccgtgcaacgtacggaaaccacctacgtgtacgttagcgttagttaataaacttctcctcgttcgtagtataccgaaactaacgtaacccgaagaaccgaaaacccgtaaccccgtaaagtccgtaactacttaacgtttaatacgtatcgttaactaagttaacgtcgttaccgttcggtacgggttactacgtccgttacttcttcgtacgtacttaccgtagtacgtcggtacgaacgtcccgtacccgttccgtaacgtacccttacgttccgttacggtccggtacctacgggacgtacggttaaacggaacggtaacggtacgggtacgttaagttaacgttttaaccggtaactaccgtacgtacgttactaaccgttatttacggaactaacggactaacgacgtaactcgttacgttaaccgggttaacgggttccggaaaggggtacccgaaccggtatacccggtacgggtacccttaaccggtcggtaacgacccggtaaccgtacgtacccggtacccgttccgaacgttacccgg

SEQ ID NO: 151612 - DNA, 710 bp, Homo sapiens
  misc_feature: GYAE6OF02IZ2ZE.7.5.A05.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (581)..(581): a, c, t, g, unknown or other
  misc_feature (581)..(581): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcgatcaccatcncctgcactcggaaccaccactgacgttcgngttagtaaataactctctcctccgtaggttactaacaaactaacgtaaccgaacggaaccaaacccgaaccccgtaacgtactaacttacgttaattttagtacgtagttacgttacttaacgtaaccgttccggtcccgtttaacgggttaccgggtttactaacgttcgtcctttctacggtcgtacctaaccgtagttccgcggacctaccggacccgtccgtaccctaccgccgtactcgtcgtcggtccgtaccgaggtaccgaggacggacggtacgtacgtacgttatttacgttacgcgtactacgcttaacagtacgaacgtacggacgaccgngtaccgcttaccggttacggttacgggttccggacgggacgtaccgacgggttacgcccgttaaccggtcggttagacccgaccggtacccgggtacgtacccggtccccgtacccgtaccggtacccg

SEQ ID NO: 151613 - DNA, 646 bp, Homo sapiens
  misc_feature: GYAE6OF02HYFFQ.7.5.A05.1.454.CMB.1.raw
tcagcgtgtctctacacgaccggtgctcgatttagatagatagacgagggggggggggtctcaggaggctagcgctctcgggacgtctccaccatggcctgggctctgctattcctcaccctccgtcactcagggcacaggggtcgtgggcccagtctgccctgactcagcctgcctccgtgtctgggtctccgtggacagtcgatccaccatcctcctgcacgtcggaaccaccactggaccgttgaccttggttaataaatctctacttcctggtatacaacaactaacccagacaaacgacccccaaagtcgataccatttactgagtgtactataagtcggccttacgtacgggtttacctaatcgtacttcgtactggctacagtactcggcgacacggacctccgtacgtacctattcgtcgtcgggacgtccgaggtctcgaagacgagctagtattaacttaagtacgacagtctaacgtacgtaactaacgacggtcgacgtacgacgacctacgtaccgtacgggttttaccgggacgggtacgggtaaccaacggccggttacggttacccggacccggttacggtccgaaccggtaccgaaccggtaccgtccggtaccccgtacggttacccg

SEQ ID NO: 151614 - DNA, 780 bp, Homo sapiens
  misc_feature: GYAE6OF02HYYFM.7.5.A05.1.454.CMB.1.raw
  modified_base (167)..(167): a, c, t, g, unknown or other
  misc_feature (167)..(167): n is a, c, g, or t
  modified_base (360)..(360): a, c, t, g, unknown or other
  misc_feature (360)..(360): n is a, c, g, or t
  modified_base (593)..(593): a, c, t, g, unknown or other
  misc_feature (593)..(593): n is a, c, g, or t
tcagcgtgtctctacacgaccggtgctcgatttagatagatagacaggggggggggtcgtcaggaggcagcgctctcgggaccgtctccaccatggcctgggctctgctattcctcaccctctcactcagggcacgagggtcgtgggcccagtctgcccgtgactcncgcctgcctccgtgtctcgggtcctcgtggacagtcgatacgacctatctccgtgacacgtcggaaaccaccgaacgttggtaccggttgcttacggttaactaactacttcctccgttccgttaggtaactaccaaacctaacacccgtaggaccgaaaccgacccccgaaagtacaactacttaatttagngttactcgttacgtaactaacgttccggtcctttacggttacggtttaccaacgttccgtacttcgtacgtcgtaccgtacgtaggtcgtcggaccgaccggtaccgtccctaccgtacgtaccgtattacccgttcggtcgggtacccaccggtacgggtccgttaaagggacgtaacggggtacgtacgtttaacggtacgttttaaccgtacgttacggcggtaaccgtntaccgtaacgagttaaccgaggggtacctccggtaacgccgtaacgttccggttacggttacccggggttacgggtccgggtaaccgaacccggcggtacccggtacggacccggtttcgtaaccgggtacccaaccgggttacccgaaccggttcccggtacccggtaccccggttacggtacccg

SEQ ID NO: 151615 - DNA, 699 bp, Homo sapiens
  misc_feature: GYAE6OF02F4Q7W.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctctggacagtcgatcaccatctcctgcactcggaaccaccacgtgacgttgcttggttaataaatctctcctcctggtactcaacaactaccgaggaccaaaccggaccccaaagtcactactatttagagtacttgtacttaagtaacgtccggtccttcgtacgggtttaccaacttccgtccttcctcgtacggcctacgtaacggtcgtacggaccgaccgtacccggtccttacccgtagtaccctagttccgttacgtcgggacccttccgagggtccgtaaggaacggtacggacggtcgttagtaacgttttacgttacgcggtactacgtcttacagttaactacggacggtcacggtacaacggtctaaccgttcggttacggtttccggggaggtaaccggaccgtaacggtccggttaccggtaacccgggtttccgaagggtttcccaaccgggtaccctaccgggtaccccgtcccggttacccccggtccggttaacccg

SEQ ID NO: 151616 - DNA, 664 bp, Homo sapiens
  misc_feature: GYAE6OF02HBWQQ.7.5.A05.1.454.CMB.1.raw
  modified_base (286)..(286): a, c, t, g, unknown or other
  misc_feature (286)..(286): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctccgtggacagtcgatcaccatctcctgcactggaaccaccactcgtacgttcgctcggttaataaatactctctcctgtatcaacaactaccacgcaacncccaatacatactattatgtatcgtactattactcgtccttcgtacgggtttaccaatcgtcttctcgtcgtcctacgaacgtcgtcggcgtaccgaccggccctacctcaccctactccgttcggtacgggtccctaccggacggtacctgggtaaaccggacggaacgtcgttacgtactttattaccgtcgtacgtactcctacaacttacgtaacggacggaccacgcgtaacgtccgtacgtttacggtacgggttttacggaccggggtaggtaacccgtaaggtcccgtacggttaaccccgttcggaaccggttacccgaccggttacccgaaccgggtcccgtccccgggttaccccgtcccggtaccg

SEQ ID NO: 151617 - DNA, 622 bp, Homo sapiens
  misc_feature: GYAE6OF02GQOKA.7.5.A05.1.454.CMB.1.raw
  modified_base (249)..(249): a, c, t, g, unknown or other
  misc_feature (249)..(249): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagcgtgtctctacacgaccggtgctcgatttagatagatagacagggggggggggtctcaggaggcagcgctctcgggacgtctccaccatggcctgggctctgctattcctcaccctcctcactcagggcacagggtcgtgggcccagtctgccctgactcagcctgcctccgtgtctgggtcctcctggacagtcatcaccatctctgcactggaaccacactgacgttgctaggttaataaatntctctcctggtatacaacaactaccagacaaacgacccaaagtacatctaattactgtatagtactaattaagtccggtacttacggtacgggttaccaactcgtcttctctcgtctcagtctgacgacncgtcctcctgaccntctcgtcgtcgtccgaaggtcgtagaacgacggagtacgtagtattacttaacgtcgtacgactctacaagtactaaccgaggtacagtaccgacgacgtacgtcgttacgggttccgggacgggtacggaaccgtaacggtaccgtacggtacccgttacggttaccggtaaccgtacggtaacccgtacgggacccgtttcccgggtaccccgttacggttaacccc

SEQ ID NO: 151618 - DNA, 745 bp, Homo sapiens
  misc_feature: GYAE6OF02HN4S0.7.5.A05.1.454.CMB.1.raw
  modified_base (227)..(227): a, c, t, g, unknown or other
  misc_feature (227)..(227): n is a, c, g, or t
tcagcgtgtctctacacgaccggtgctcgatttagatagatagacgagggggggggtctcaggaggcagcgctcgtcgggacgtctccaccatggcctgggctctgctattcctcaccctcctcactcgagggcacgagggtcgtcgggcccagtctcgcctgactcagcctgcctccgtgtcgtcgggtcctcctggactagtcgactacacctactcctccgtcncacgtacgaaaccactacgtcgtacgttcgtcgttaggttaataagttacttccgttacttccgttaggtaactacaaactaaaccgtaaccgtaacggaaccaaacccgaaccccgtaaagtacctaacttacttaagtttatcgtagttacgttacttaactacgttccggtaccgtttacgggttacgggtttacctaacgttcgttacttccgtcggttaccgacttaccgtacgttcggtcgtaccgaccgtacccggtccctaccgtaccgtaaccgtacgtccgtcgtccggtacccgtacgtacgggtacgtaagaacggtaacggtacggtactaagttaacgttaacgtacgtacgacgtcgtactaactacgttaacgacgtacggacgtacgtacgacggtacttacggtacggtacgggttacggaccggacgggtacacggtccgtaccgtaccggtacgtccgtaacgaccgtacggaccgtccgtccgtacccgtcggtacc

SEQ ID NO: 151619 - DNA, 830 bp, Homo sapiens
  misc_feature: GYAE6OF02IGBGV.7.5.A05.1.454.CMB.1.raw
  modified_base (203)..(203): a, c, t, g, unknown or other
  misc_feature (203)..(203): n is a, c, g, or t
tcagcgtgtctctacacgaccggtgctcgatttagatagatagacgaggggggggtctcaggaggcagcgctctcgggacgtctccaccatggcctgggctctgctattcctcacctcctcactcaggcacgagggtcgtggcccagtctcgccctgactcacgctgcctccgtgtctgggtctccgtggacagtcgatcacntctctgcacgtcggaacccacacgtgtacgttgcgttaggttaataacgtctctctccgtgtactacaacaactaccgagacaacgaccctaagtcatactattatgtatgtactatacgtaccgtcttaacggtacgggttacctaacgttcgttccgttcgtcgtacgttaccgtaccgtaacgttcgtaccggtaccgtaccgtaacccggtcccgttacccgtaaccgaccgttaacgttccgttaccggtccgggttaccgtaccggtaacgggttccgtaacgggaaacggttaaccgggacgtacgtttaaccggttaattttaaccggttaacgttccgtacgttaaccgtaccttaacgtaacgttaaccgtaaccggtacggttaaccgaacggttacccgaacgtttaacccgtaccgggtttaaacccgggtttaccgggtttacccgggggaaccgggttaacccggtaaaccggtacccgggttaaaccggttaccccggttaaccgggtttaaacccggttcccgggttaaacccgttccccgggaaaccggtttaaacccgggccccggtttaaaccccggtcccccgggtttaacccggtttaaccccgg

SEQ ID NO: 151620 - DNA, 691 bp, Homo sapiens
  misc_feature: GYAE6OF02IRZQH.7.5.A05.1.454.CMB.1.raw
  modified_base (136)..(136): a, c, t, g, unknown or other
  misc_feature (136)..(136): n is a, c, g, or t
  modified_base (543)..(543): a, c, t, g, unknown or other
  misc_feature (543)..(543): n is a, c, g, or t
  modified_base (635)..(635): a, c, t, g, unknown or other
  misc_feature (635)..(635): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcaacgnggggtcgtgggcccagtctcgccctgactcagcctgcctcgtgtctgggtcctccgtggactacgtcgatccacgatctcctgccacgtccggaaccacctacgtggtacgttgccttaggttaaataaattcctcgttccgtaccgtggttaacctacaaaactaacctacccgaagtaccaaacccgtacccccgaaagtccttaatacttaactttgtaaggtacttgttaacctaagttactccggtaccgtttacggtaccggtttacacgtcgtacttctccgtcgtacctacgtacgttcgacgacgtacgcccggtaccctcccgtagacctacttcgaccggtcggcctaacggcgtacacgggtaacgcggtagtctagtactttagcgtagacctntacctatacctaacgtacggtacgacgtaagtccacgtaactccggttacggttaccgggttacgacgggaacgtaccgacgttaacccggngtacccggttagtaacccggcctaacgccgaacggccttaccccgccgtacgtacc

SEQ ID NO: 151621 - DNA, 676 bp, Homo sapiens
  misc_feature: GYAE6OF02F9HBE.7.5.A05.1.454.CMB.1.raw
  modified_base (346)..(346): a, c, t, g, unknown or other
  misc_feature (346)..(346): n is a, c, g, or t
tcagcgtgtctctacacgaccggtgctcgatttagatagatagacaggggggggggtctcaggaggcagcgctctcgggacgtctccaccagtggcctgggctctgctattcctcaccctcctcactcgagggcacgagggtcgtcgggcccaggtctcgccctgactcagcctgcctcgtgtcgtgggtcctcgtaggacagtcgactccaccgtatccgtctgaccacgtacggaaacccacctacgtgtacggttgcgttaggttaaataaaactctctctaccgtagtactacaaacaactaccgacggaaccaaaccgacccctaagtcactactagttangtagtcgtactagtacgtccgtacttagtacggttacagtctctctctcgctactacgtcgtcgaccgacgcccgtcgtaccgtacgtcctacgttcgtcgtccggtctaccggagtcgtacgaacggtacgacgtacgtagtactttacgtacgtacgtcgacgtcgtaactacgtacgtacgtacggacgtacgcgtacgtaccgtaccggttacggttacgggtaccgggaccggttacggaccgttaacggtcggttacccggtaacgttacccggtagtaccgaccgtcccggaccgtcccgtaccggtcccgtaccgttacccg

SEQ ID NO: 151622 - DNA, 789 bp, Homo sapiens
  misc_feature: GYAE6OF02G07GH.7.5.A05.1.454.CMB.1.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
tcagcgtgtctctacacgaccggtgctcgatttagatagatagacgaggggggggggtcgtcgaggaggcagcgctctcgggacgtctccaccatggcctgggctctgctattcctcaccctcctccactcgaggctacaggggtcgtcgggccacgtctcgccctgactcacgcctcgcccgtcgtcgtcgtgggtcctccgtaggacgagtcgatcacctntctacctncctacgtacgaacctaccacctggtaacgttcgcgttaggtttaataaagtacttcttaccgttccgttagtactaccaaacgtaaccgttaacccgaacggaaccaaaacccgacccccggtaaaactccttaactaccttaagttttacgtaggtagttactaactagttaacgtccggttccttacgggtaccggtttacgtaacgttctacgtttccttcgtaccggtccttaaccggtacgttaggttccggaccgtacgggtacccctaccccgttccgaactacgtactcgtccgtcgtaccgtcgacggtcctaacggtagacggtacgtacgttacgtacgttacgttaacgtccgtaccgtacgtacttaaccgtagttaaacgaaccggacggtacgtaccgacggaacctaccgttacccgttaaacggttaccggggtttacgggaccggtaccggacgtaacgtaacggtcccggttacgtaaccggtaccgtaccggacccggtaacggtccgtaaccgtccccggtcccgttacccgtcccg

SEQ ID NO: 151623 - DNA, 585 bp, Homo sapiens
  misc_feature: GYAE6OF02G6M4U.7.5.A05.1.454.CMB.1.raw
  modified_base (211)..(211): a, c, t, g, unknown or other
  misc_feature (211)..(211): n is a, c, g, or t
  modified_base (306)..(306): a, c, t, g, unknown or other
  misc_feature (306)..(306): n is a, c, g, or t
  modified_base (464)..(464): a, c, t, g, unknown or other
  misc_feature (464)..(464): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatcctccngcactggaacccaccactgacgttgccgttaataaatatctctcctggtatcaacaactacccgagaccaacgacccccaagtacatctatttangatgtactataatccggcttcgtagggtttccagttcgtccttcttctacgtctaccgtagtcgtcggacgaccgaccggcccttccctgaccctatcctcggtacgggcctaccgcggtactagaacggacgaggctagtattacttcagctcgctnactacaacaggcacgacacgtcacgttcggtacgggttcggacggacggaccaggtccgtcggaccgttccgagtcccgacgacccgacggtaccgtcccggccccgttcggacctacccg

SEQ ID NO: 151624 - DNA, 741 bp, Homo sapiens
  misc_feature: GYAE6OF02IN8DZ.7.5.A05.1.454.CMB.1.raw
tcagcgtgtctctacacgaccggtgctcgatttagatagatagacagggggggggggtctcaggaggcagcgctctcgggacgtctccaccatggcctgggctctgctattcctccaccctcctcactcgacgggcacagggtcgtcgggccagtctcgccctgactcacgcctcgcctccgtgtcgtcgggtcctcctacggacagtcgactaccaccacttctccgtcgactacgtacgaaccacctacgtcggtacgttcgtacgttaggttaataaacttactcttacctccgttaggtactaaccaaacaactaaccgaacggaaccaaaacccgacccctaaaagtacctaactactaattttactagtaactcgttaacttagtaacgtacggtcgttacggtacggtttaccaacgtccgtcttcctcgtacgtcctacgtaacgtcgtacgacgtaccgtccgtaccgtcctacgaccgtaactcgtaccgtacggtacctaccggtacgtacgtacggaaacggtacggaacgtcttaacgttacttaaacgtttacgacgtacgtactactacaactttacgaacgtacgagtaaccgcgtacgtaccgtacgttcggttttaaccgggacggtacggggaacgtaccgtacgggtcttaaccggtacccggtaacgttaccggaacgacgacccggtacggtcccgtacccggtacccgtacgtacccg

SEQ ID NO: 151625 - DNA, 662 bp, Homo sapiens
  misc_feature: GYAE6OF02F8V2A.7.5.A05.1.454.CMB.1.raw
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcgagcctgcctcgtgtcgtgggtctccgtggactagtcgatcaccatcctcctgctacgtcggaacccacctactgtacgttgcttaggttaataatctctctcgtgtatacaacactaccgagaccaacgcccaagtcatctattangntcgtatatacgtcgtcttgtacggttcagtctctctcgtcgtctacgtacgtcgtggtaccgacgtaccgtccctaccgtacctacctacgttcgtcgtcgggtcctacggagtcgtaagggaacgtacggacggtacttacgtaagtttaacttacgtcgtaagtaccctgtaactaacgttaacgaccgaacggtacaacggtacctaacgtaccgttacgttacggttaacggggttaccggacggggtaacgtaccgacggtcccgttaacggaccggtttaccgacggtacccgtaccggacccgtacggttacccctccccgggttaccccgtacgttacccg

SEQ ID NO: 151626 - DNA, 571 bp, Homo sapiens
  misc_feature: GYAE6OF02GMZY0.7.5.A05.1.454.CMB.1.raw
  modified_base (127)..(127): a, c, t, g, unknown or other
  misc_feature (127)..(127): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagcgtgtctctacacgaccggtgctcgatttagatagatagacgaggggggggggtctcaggaggcagcgctctcgggacgtctcaccatcggcctgggctctgctattcccacctcctctctcncgaggacaggtggtcggcgcgctcgtcgcgtctcactctcgctcgtcgtcgtcggtcggtctacgacgtaggacgtctcacacttacgcttcgcacggttacgtacaactccgtaaccttcgggaatcgtcggtataatatcgtctactcgtcactnaacncggacaggacaccgtatacctgtacngtntactgactancttcacgtcnctaaggtctcgtctacgttntctcgactcncgtntacgcgtcgacgcgtctcacgcnctcgtcgtcgtacgtctcgtcgtagtacgtacgcgtacgtatactctacgtcgacgtactcgtacacgtcgacgcgacgtacgacgtcgtacgtacgtacgttacgtaccgtcgtacgtacgtcgtctcgttaccgtacgtactaccgtcgtacgtaccgtacgtccgtacgtgtcg

SEQ ID NO: 151627 - DNA, 690 bp, Homo sapiens
  misc_feature: GYAE6OF02JA86V.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtcgtgggtctcctggacagtcgatcaccatcctccgtgcactcggaaccaccactgtacgttgcttggttaataatatctctcgtgtactcaacaactaccaggacaaacgcccccaaagtcactctaatttatagatgtatataagtcggtccttcgtagggtttaccaatcgtacttctcgtgtcctacgtaagttcgtcggacgacgaccgtcctaccctcgaccactaccgtcgtccgggcctcccgacggtcgtaacggaacggacggtaacggacgttagtacgtttacgtttaacgtcgtacgtacgtacttacctaacgttaactaacgtacgggtaccacgaccgtacgtacctaacgttccggtttaacggggttttaccggggacggggtacccggggtaaccgtaacgggtccgttaaccgggtacccggttaaccggttaccggtaacccgtacggacccggtaacggtcccggttcccggttacccccgtcggttacccc

SEQ ID NO: 151628 - DNA, 889 bp, Homo sapiens
  misc_feature: GYAE6OF02IIBC5.7.5.A05.1.454.CMB.1.raw
  modified_base (203)..(203): a, c, t, g, unknown or other
  misc_feature (203)..(203): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctcgtgtctcgggtctcctggacagtcgatcacntcctctagctacgtcggaacccaccgactcggtacgttcgccttagggttaactaaactactccttaccgttacctacggtaataccgtaaactaaccgttaaccccgacggtaacctaaaaccggacccccctaaacggtcctaacgttaaccgtatttaacgtacgtagttacggtaacttacgtaacgttaccggtaccgtttaacggtaccgggttttaaccaacggttccgtccttaccgttccgtaccggtaccgtttaaccgtaacgttccggtacgggtacccggtaccgtacccggttacccgttcccctacgtaacccgttacgtaccgttacggtttccgggaccttacccggagggtacccgttaacgggtaaacggtcgggaaccgtttccggtaacgttaacggttttaaccgttacgtacgttaacccggtaccgtacttaaccgttacgtaaacgttaccgtacgggaacctaccggtacaacccggttcgttaaccgttttaaccggttacggggtttaccggtaaccggggacgtacccggtaacggttacccggttaaccgggttaacccgttaaccgggttacggtaaacccccggtacggttaaccccccgggaagggtacccccggtttacccgggtacccccccggttaaggttaacccccgg

SEQ ID NO: 151629 - DNA, 737 bp, Homo sapiens
  misc_feature: GYAE6OF02JRCF3.7.5.A05.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (560)..(560): a, c, t, g, unknown or other
  misc_feature (560)..(560): n is a, c, g, or t
tcagcgtgtctctacacgaccggtgctcgatttagatagatagacgagggggggggtctcgaggaggcagcgctctcgggacgtcctccaccatggccctgggctctgctattcctcaccctcctcactcagggcacagggtcgtgggcccaggtctcgccctgacctcgacgcctgccgtccgtgtcgttgggtccgtcgtggacgtgtcgatcacctagtcctcgtcgctacgtacggaacctaccacgtctaccgtcgacgttggttaataaactatctacctcgtgactacaactacgtacccaggaccaaccgcccgaagtcctatactacttanaggtntagttactactacgtccggttactaccggttacgggttacctacgtccggttcttccggtccgtacggttccgtacgtacgttcgggtaccggacctacggacccgtccccgtcttaccccggaacttccgtcgaccggtcggtacctaccggaggttccgacggtacggaccggtcggctaagttactacggttaccgttgtaccgacgttacncgtacttacgtaccggacgtaccgggactacggacgacgtaccggttacggttaccggggttacgggaccgggacgttaacccgggtacgtacggttcccgtaccggtaaccgggttcgacccggttacccggaccggtaacctcgggtaaccccgttccggttacccgttaccccg

SEQ ID NO: 151630 - DNA, 668 bp, Homo sapiens
  misc_feature: GYAE6OF02I31AY.7.5.A05.1.454.CMB.1.raw
  modified_base (330)..(330): a, c, t, g, unknown or other
  misc_feature (330)..(330): n is a, c, g, or t
tcagcgtgtctctacacgaccggtgctcgatttagatagatagacaggggggggggtctcaggaggcagcgctctcgggacgtctccaccatggcctgggctctgctattcctcacccttcctcactcagggcacgaggggtcgtcgggcccagtctcgccctgactcagcctcgccctccgtgtctgggtcctccgtggacagtcgatcaccatcctcctgcactacggaacccaccactcgtcgttgtcttaggttaataaatctctctactgtactcaactactaccgagaccaaaccgaccctaaagtcatactaatttatgtatntactatactccggtccttggtacggttaccatcgtacttctcgtcgtactacgagttcgcggacacgccggtccctcccgtagacctacgttctcggtccggtcccgtcgacggtacgtaggaacggaccgtaggtcttagttaaccgttattaccgtataccgacgtccttactaagttaaccgtaacgacgtccgaacgtacgtacgtaccgtacctttcggggtaacgggttccgggaagggaccgtaccgacggtaccggtccgtaacccgggttcttaccgggtacaacccggccggtaaccggttccctaccccggtcccgttaccggtccc

SEQ ID NO: 151631 - DNA, 715 bp, Homo sapiens
  misc_feature: GYAE6OF02IK19Y.7.5.A05.1.454.CMB.1.raw
  modified_base (376)..(376): a, c, t, g, unknown or other
  misc_feature (376)..(376): n is a, c, g, or t
  modified_base (494)..(494): a, c, t, g, unknown or other
  misc_feature (494)..(494): n is a, c, g, or t
  modified_base (559)..(559): a, c, t, g, unknown or other
  misc_feature (559)..(559): n is a, c, g, or t
  modified_base (570)..(570): a, c, t, g, unknown or other
  misc_feature (570)..(570): n is a, c, g, or t
tcagcgtgtctctacacgaccggtgctcgatttagatagatagacgaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcatcaccatctctgacactcggaaacccacctacgtacgtacgttgccgttaaggttaataaaattacttcctaccttccgttaggttaactaccgtaaaacctaaaactaaccccgtaacgggaaccaaaaaccggaaccccccctaaaaggttaccaattacccttaattttaacgngtaattagttaactaattaacgtccgttaccgtttacgtacggggtttaccaattcgttacttctacgtcggtactacctagtcgtacggcgtaaccgaccgccctccgacgtaaccntcgtcgtacgctaccgagcgtaacgaagacgagtactagtattacttacgtgacatctacataanacgaacggacncgacacgtactacgtacggtacggtttacggacgggaaccgtacgacggtccgtaccggtaacccgttccggttaacggtaaccacccgggtaaccccgtaacgggttacccgtacccccggttacccccggtccgttaaccccg

SEQ ID NO: 151632 - DNA, 703 bp, Homo sapiens
  misc_feature: GYAE6OF02GGT8B.7.5.A05.1.454.CMB.1.raw
  modified_base (212)..(212): a, c, t, g, unknown or other
  misc_feature (212)..(212): n is a, c, g, or t
  modified_base (219)..(220): a, c, t, g, unknown or other
  misc_feature (219)..(220): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (446)..(446): a, c, t, g, unknown or other
  misc_feature (446)..(446): n is a, c, g, or t
  modified_base (520)..(520): a, c, t, g, unknown or other
  misc_feature (520)..(520): n is a, c, g, or t
  modified_base (564)..(564): a, c, t, g, unknown or other
  misc_feature (564)..(564): n is a, c, g, or t
  modified_base (604)..(604): a, c, t, g, unknown or other
  misc_feature (604)..(604): n is a, c, g, or t
tcagcgtgtctctacacgaccggtgctcgatttagatagatagacgagggggggggtctcgaggaggcagcgctcgtcgggacgtctccaccatcggcctgggctctgctattcctcacccttccgtcactcgagggcacgagggtcgtgggcccagtctgccctgactcagcctgcctcgtgtctgggtctcgtggacaggtcgatcaccntcctacnncacgtcgaaccncngttgacttgcttaggtaactaatctctctactgtactacaactaaccgtaccgagaacgaaacccgtaacccgaagtactacctattacgttatgtatacggtactaataacgtccgtccttacggtaggttacctaacgtccgtctttacgtcgtacgtccgtacgtaacgttcgtacgacggtaccgacccggtccctcgtaccgtaacngttccgttcgtacgggctaccggtgggtacacggaaacggtacaccgggtaatcggttaaacttacgggttacnggtactaacgcttaacctattacgtacggaacgtgaccgtaacncgtaccgttaacgttcggttacggttacgggaccggttanaaacccggtcggtttaccaccggggttacccttacggtaacgtcgtaacccgccgggttaaacggtcccgtacccccggttaccggttccgggtacccc

SEQ ID NO: 151633 - DNA, 691 bp, Homo sapiens
  misc_feature: GYAE6OF02IJA5K.7.5.A05.1.454.CMB.1.raw
tcagcgtgtctctacacgaccggtgctcgatttagatagatagacaggggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacaggttcactccaccacttctcctcgtcacgtacggaacccaccacttggtacgttgtacttaggtttaataaacttacttacttccttccgttaggttactaccaaactaactaaccgtaacggaccaaaccgacccccaaagtcctactacttatttacgtagtatacgttactaagtaattccggtacctttcggtaacgggttttacctaactcgttacctttctactcggtacctaccgtaagtcgtacgacggaccgaccgtcctcccgtacgaccctcgttacctcgtcggcctcgacggtactaggaacgacgtagcgttagttaatacgttactacgacgtacctcgtaactagtaacgtacgtacgacgtcgaagacgtaccacgttacggttacgggtttacggacgggtacggacgtacggtccgtacgtaccgtcgtaccgttacgacggaccgtacggtcccggtaccgccccgttcgtaccccg

SEQ ID NO: 151634 - DNA, 626 bp, Homo sapiens
  misc_feature: GYAE6OF02IFS7T.7.5.A05.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcgagggcacgagggtcgtcgggcccagtctgccctgactcagcctgcctccgtgtcgtgggtctccgtggactagtcgatcaccntcctctgcacgtcgaaccnccactgacgttgcgttagttaataaatnttcctcttccgtagtactacaactaactacccgaagaccaaaccgaccccaatctatactatttancgtatcgtactatacgtccgtcttacggtacggtttaccaactcgtcttcgtcgttcgctcgtatcgacgtacgaccgaccgtcctccgtacgcctatcgtcggcgtactcggacgtagaacgtacgacggtntcgtagttaattacgtacgtnacgtctctaactatacgtacgaccggatcgacgtcgtacctcggtttacggttccgggttacgggacggtacgaccgtacggccgttaaccgccgttacgaccgtacgaccgtacgtaccgcccggtacccggtccccgtgttacccg

SEQ ID NO: 151635 - DNA, 728 bp, Homo sapiens
  misc_feature: GYAE6OF02I1W30.7.5.A05.1.454.CMB.1.raw
  modified_base (135)..(135): a, c, t, g, unknown or other
  misc_feature (135)..(135): n is a, c, g, or t
tcagcgtgtctctacacgaccggtgctcgatttagatagatagacgaggggggggggtctcaggaggcagcgctctcgggacgtctccaccatggcctgggctctgctattcctcaccctctcactcagggcacngggtcgtgggcccagtctgccctgactcagcctgcctccgtgtctgggtctccgtgactgtcgatccacctatcctaccgtgacctacgtcggaaacccacctagtcggtaccggttgccgtttaggttaaataaacttctcgttccttccgtaggtactacaaacctaaactacccgaacggtaccaaaccgaacccccgtaaatactactacttattatgtattgtactagtacgtccgtccgtacgtcggttacctactcgtcttctcgtacgtcctacctagtcgtacggaccgacgtcggtacccctacctccgaacctctccgttcgggtaccggtaccgtccgaacggacgtaacggtaacggtaccggtaggtaccttacgttaactttacgtacgtcgacgtacgttaccgtctaaacgtagtaccggacgacgtacgacgtaacgaccgtttacgtaccggtttaacggggttccgggaacgggttaccggaacggtcggtaaccggttaccggtaccgttaaccggtacgtacccgacggttaacccgcgtccccgtacccggtcccccggtgttaaccccg

SEQ ID NO: 151636 - DNA, 696 bp, Homo sapiens
  misc_feature: GYAE6OF02HPNRG.7.5.A05.1.454.CMB.1.raw
  modified_base (217)..(217): a, c, t, g, unknown or other
  misc_feature (217)..(217): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcgagggcacgagggtcgtcgggcccaggtctcgccctcgactccacgcctcgccctccgtgtcgtgggtctccgtggacagtcgatcaccntcctcctgcactcggaacctaccacgtcgtacgttgcttaggtaataaatctctctcgtgtaactacaaactaactaccgagacaaaccgacccctaaagctactactatttatgtacttgtactactaacgtccgtacctttcggtacgggtttacctactccgtctttctcgtcgtctaccgtacgtcggtacgccgtaaccgccgtccctacccgtacacccgttactccgtccggtcgggtccctacgggcggtcgaaggtaaacgggtccgaggttctaacggttaatttacgttaccgtcaccgtgtaccttactacgtacgtacgaacggtaccgacgtcgtaaccgtactccgggtttaacgtaacggggtttccgggacggtaccggtacgacgggtccgtacccgtacggtccgttaccggacgacccggttaccgacggtcccgttccccggtacccgtggtaccccg

SEQ ID NO: 151637 - DNA, 806 bp, Homo sapiens
  misc_feature: GYAE6OF02F2R40.7.5.A05.1.454.CMB.1.raw
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccacgtgacgttgctggttaataatatctctctggtatcaagaataccaggcaaacgccccctaaagtcataccgtatttatgtatcgtctaattaacgtccggtacctttcgtacggggtttacccaagttccggtactttccgtcgttcgggtccttcccgtaaaggttccgttacgggaccgtaaccgtaacccgggtacccgtttcccccgtacggaacccggttaactacccggtttccgttaccgggggtacccttacccggtaacggggtacccttaacgggaaacggtaaacccgggtagggtaccgttacggtaacgttttaaaccgtttaaaccgtcggtaaccgacggttacctacgtaacgtttaaacgtaccgaaggggtaccaacgggtaccgtacgacccgttaaccgttccggtttaacggggttttaccgggaaccggggttacgggtaacccgtaagggtacccgttaaccgggtaccccggttacccgtttaaccgggtacctaacccgggtacccggaaacgggttccccgtaccccggttacccccgggtacgtttaacccccgg

SEQ ID NO: 151638 - DNA, 723 bp, Homo sapiens
  misc_feature: GYAE6OF02JJMUV.7.5.A05.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (589)..(589): a, c, t, g, unknown or other
  misc_feature (589)..(589): n is a, c, g, or t
tcagcgtgtctctacacgaccggtgctcgatttagatagatagacgagggggggggtctcaggaggcagcgctctcgggacgtctccaccatggcctgggctctgctattcctcacctcctcactcaggcacgaggtcgtggcccagtcctgccctgactcagtcctgcctccgtgtcgtcgggtcctccgtggacgngtcgactccacactctcctgcacgtcggaaccactacngtaccgtgtctaggttaataaattctcgtctccgttaggtactaactaacaaccgtaccgaacggtaccaaaccgaccccgtaaagtacctacttacgtaactttagtagtacgttgtaaccttaataacggtccgttaccgttcggttaacgggttacctaacgttccggtcttacgtcgttccggactacggtataccggtgaccgtaccgtaccgcccgtaccgtacgctagtccgtcgtacgccttacgcgtagtacgtaaccggagtcggtacagttacgttaataccgtcgactacgtactacttaaccgtataacgacgttaccgcgtaaccgtacgtaaccgttnttaccgggttaacgggtttccgggaaacggttacggtaaccgtacgggtacgttaaccggtaccgtaacggttacgaccggtaaccggtaccggaaccggttccccgaacccggttccccgcgggtttaacccc

SEQ ID NO: 151639 - DNA, 652 bp, Homo sapiens
  misc_feature: GYAE6OF02IM39U.7.5.A05.1.454.CMB.1.raw
  modified_base (461)..(461): a, c, t, g, unknown or other
  misc_feature (461)..(461): n is a, c, g, or t
  modified_base (588)..(588): a, c, t, g, unknown or other
  misc_feature (588)..(588): n is a, c, g, or t
tcagcgtgtctctacacgaccggtgctcgatttagatagatagacaggggggggggtctcaggaggcagcgctctcgggacgtctccaccatggcctgggctctgctattcctccaccctcctcactcagggcacagggtcgtgggcccagtctgccctgactcagcctgcctcgtgtcgtgggtcctccgtggacagtcgatccaccatcctcctgcactcggaacccacctactggtaccgttgaccttaggttaaataaactcttcctctccgtggtactaccaaacaacgtacccaaggaccaaaaccgacccccaaaagtccaactactaattttagagtactgttactaataacgtccggtacctttacggtacgggtttaccaatccgtcttctcgtcgaccttactagtcgtacgcgaccgtccgccctccacgacctactctcgtcggtccncgagtcgtagaacgacgagtctagtaattacttgacgctagctacgtaatacgacgaggacagaccacgtacctacgttacggttaccgggttagggaacgggacggtaccaacggtccggtaaccncccggttaactaccgggaacacccggtaccgacgtcccgtaccccgtccccggtagttaccccg

SEQ ID NO: 151640 - DNA, 655 bp, Homo sapiens
  misc_feature: GYAE6OF02I46Q5.7.5.A05.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtcgtgccctgactcagcctgcctccgtgtcctgggtctccgtggacngtcgatcaccatctctgcacgtcgaacccacactggtaccgttgcttaggtaactaaatctctcttccgtgtactacaaactaactaaccgacggtanaaaccgaccccctaaagtcataccttaagtttatacgtaagttacgttactaattacgtccggtccgtttacggtacgggtttaccatccgttcttcttagtcgcttaccgacgtcgcgcgactccgggccctcctcgaactcttaccgtcggtcggtcctaccgacgtcgtagtacgacgtcggtatacggtattacgttactcgacttcgactagtaactgttaacgcgtaacgccgatacgccttacgtacggttcgggttccgggaagggtaccggaacgtacgtccgttaccggtactaccggttccgacggttacgacccggttagtccccggtcccgtaccccggtcgtaaccg

SEQ ID NO: 151641 - DNA, 850 bp, Homo sapiens
  misc_feature: GYAE6OF02HC0IC.7.5.A05.1.454.CMB.1.raw
tcagcgtgtctctacacgaccggtgctcgatttagatagatagacagggggggggtctcgaggaggcagcgctcgtcgggacgtctccacatggcctgggctctgctattcctcaccctcctcactcgagggcacaggggtcgtgggcccagtctcgccctgacctcacgcctcgcctccgtgtcgtcgggtcctccgtaggactaggtcgataccgacctatcctccgtagcctacggtaccggaaccctaaccgacgttacggtaccggtttaggtaccgttaggtttaaactaaagttcttcctaccgttccgtacggttaataccctaaaaccttaaccgtaaccccgaacggaaccgtaaaccgtaacccgttaaccctaaaaggttacccttaacgttaccttaacgtttttaacgtaaggttaacggtttacgtaaccgttttaagaaccggttacccggtttaccgtttacgggtaccggggtttttaacccaaccggttcgttaaccctttccgtccggttacgtacccgttacgtaacgtttcgtacggaccggtacccgtaccgttaccccgtacctaccgtacctaaccgttccgtacggtccggtcctaccggcggtaccgtaggaaccgtacgggtacggtatacggttattaacgttagttaccgcttaacggtctaacgtagtaaccgttacgacggtacgaacgtaccgacgtaccgtaccggttacgggttaccgggttccgggtaccgggtacggtaaccggtcggtacggtacctccggtaagtccgtaacgccgtaccggtaccggtcccggtaccgtcccgttaaccg

SEQ ID NO: 151642 - DNA, 634 bp, Homo sapiens
  misc_feature: GYAE6OF02G236D.7.5.A05.1.454.CMB.1.raw
  modified_base (390)..(390): a, c, t, g, unknown or other
  misc_feature (390)..(390): n is a, c, g, or t
tcagcgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtcctccgtggacagtcgatcacatctcctgcacgtggaacccacactgacgtgctggttaataaatctctctctggtactacaacaactaccgacggacaaaccgaccccaaagtccattctatttacgtgattcgtacttactaacgtcggtacctttacgtacgggtttaccaacgttcgtccttctcgtcggaccttacgaacgttntcggtaccgacgaccgtccctcccgtacgacctacgtccttacggtcggacctcgacgggctacggaagcgacgtgtactagtttactacgtacgcgactctactaatatacgacgtcacgctaagcctacgtcggttacgggttaccggacgggacggaccgtaacggtccgtacggtacccggttactaccggtaccgaccggtaccgaaccggttcccgacccggtccccgtcggttaccc

SEQ ID NO: 151643 - DNA, 686 bp, Homo sapiens
  misc_feature: GYAE6OF02JEIS3.7.5.A05.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (452)..(452): a, c, t, g, unknown or other
  misc_feature (452)..(452): n is a, c, g, or t
tcagcgtgtctctacacgaccggtgctcgatttagatagatagacagggggggggtctcaggaggcagcgctctcgggacgtctccaccatggcctgggctctgctattcctcaccctctcactcagggcacgagggtcgtgggcccagtctgcctgactcagcctgcctcgtgtctgggtcctctggacngtcganccacntctcctcgacacgtcggaacccaccacgtgtacgttgcgtaggttaataaatacttcctcttccgtgtacaccaaacaacgtacccgaggaaccaaaccgaccccgtaaagtctactacgtattacgtagtacttcgtacttagtaacgtccggttccttacggttaacgggttacctaacgtcgtacctttctcgttcggacctacgtacggttacgcggtaccgacgtaacccgcccttaccgtaccnccgtagtccgttaccggtcggtacctaccggacggtaccgtacgtaacggtacgggtaccgttcgtaagttacctttaacgtacgtgaaccgacgttctacgtataaacgtcggacgacgtacgctacggactcggtacgttcgggttacgggaacgtacggacgaccgtcgtccgtacgtaccgttacggctaccggaccgtacggcccgttacccgtcccggacgttacccg

SEQ ID NO: 151644 - DNA, 769 bp, Homo sapiens
  misc_feature: GYAE6OF02JNI1E.7.5.A05.1.454.CMB.1.raw
  modified_base (615)..(615): a, c, t, g, unknown or other
  misc_feature (615)..(615): n is a, c, g, or t
tcagcgtgtctctacacgaccggtgctcgatttagatagatagacaggggggggggtctcaggaggcagcgctctcgggacgtctccaccatggcctgggctctgctattcctccaccctcctcactcgagggcacagggtcgtcgggcccagtctcgcctgactcacgcctgcctccgtgtcgtgggtctccgtggacagtcgactcaccattcctcctgctaactccggaaccacctaacgtcggtacggttacgacgttaggttaaacttaaaatacttcctccgttccgtacgggtacttaaccgaaaacctaaacctaaccccgaacggtaccaaaacccgtaacccccgaaacgtactaacttactaactttagtacggtacttacgtacttaaattaaccggtccgtccggtttaccggttaacgggttacctaactaccggttcttacgtcggtccgtactacctaacgtcgtaggtaccacgaccgtcctcctacgacctacgtctcggacgtcccgtacgacgtacgtaacgtacggacgtacgtacgtagtattacgttacgacgtcacgcttaactagtaacgtacgacgtaacgacgtaccncgtaacctcgtttaacggttaccgggttacgggtacgaaccgggttaacccgacggtaacccggtaccgtaacccggttccgttaaacgggaccgttaaccctacccggggttaaccgtccccggtacccggtacccggttaccggtaccccgg

SEQ ID NO: 151645 - DNA, 755 bp, Homo sapiens
  misc_feature: GYAE6OF02H1HAA.7.5.A05.1.454.CMB.1.raw
  modified_base (169)..(169): a, c, t, g, unknown or other
  misc_feature (169)..(169): n is a, c, g, or t
  modified_base (181)..(181): a, c, t, g, unknown or other
  misc_feature (181)..(181): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
tcagcgtgtctctacacgaccggtgctcgatttagatagatagacgagggggggggtctcaggaggcagcgctctcgggacgtctccacatggcctgggctctgctattcctccaccctcctacactcgagggcacgagggtcgtcgggcccagtctcgccctgactcngcctgccctcgngtacgtggtcctccgtggacagtcgatccacntcctccngcacgtacgacccactctgtacgttcgcgttaggttaataatctcttacgttcccgtaggtacaaccaactaaactacccgaaggaaccaaacccgaccccccgtaaagtcctaacttccttaagttgtacgtaattcgttactacttaacgtttaccggttccttacgggtcggttaacctacttccgtatttccgcgtcggtactaaccgagttccgtagcccgtacacccgggtccctcccgaacgtacctcgttccgttcggtacggtccttacggcgtaacgagaaccgggtaccgtagtcgtaacgttactagttacggtcacggttctaccgtataagtaacctacggtacgtaccgagtaccgacttcgttaaaccggtggtttaaccggggttaccggaccggggtacgtaacccggttacggaacccggtttacccggacccggttttcgaaacccggtgtaacccccgtaaccggggtcccgttacccccggggttcccgacccccggtttccggttaaccccg

SEQ ID NO: 151646 - DNA, 669 bp, Homo sapiens
  misc_feature: GYAE6OF02F3IWI.7.5.A05.1.454.CMB.1.raw
  modified_base (247)..(247): a, c, t, g, unknown or other
  misc_feature (247)..(247): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatntctctcctgtatcaactaataccaggcaaacgccccaaagtcatctattatgatgtctataactcgtccttcaggggtttccaatcgtctcttctcggctccaagtctcgcgacacgcctccctacgacctacgtctcgtcgggcctccgacggctaggaacgtacggtacggtcgtagtaactttactttacgtgtaccacggtacctacgttaactaactaccgtaacgggacgtagtaccgtacgtaccgtaaccgttccggtttaacggggtttaccggggtaccggggtaacgggaaccgttaaaccgggtccgttaaccggtaaccccggttcccggttaaccgggttacccgtaacccggtacccggaaccgggtaccccggttcccgtaccccccggttcggtttaacccccgg

SEQ ID NO: 151647 - DNA, 589 bp, Homo sapiens
  misc_feature: GYAE6OF02GXB3S.7.5.A05.1.454.CMB.1.raw
  modified_base (349)..(349): a, c, t, g, unknown or other
  misc_feature (349)..(349): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
tcagcgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctggtctcctggacagtcgatcaccatctcctgcactggaaccaccactgacgtttgcttggttataaatatctctcctggtactcaacatacccaggccaaacgcccccaaagtcactctagtttatgattgtactataacttcggccttcgacgggtttaccaagttccgntttcctcgtggtacctaccgagtctaggcgacacggcccttcccgtgtaccactctcgtggcctcgagtcgtagacgacgacggtctagtattacttacgngtacgacnctntacgtactacgagtacacgcacgcacgttacgtacgggtttcggacgggtacggaacctacggcttacggacccgttacgtacgcgtaaccgcccgaacggccgtacccggtccccgttcggtacccg

SEQ ID NO: 151648 - DNA, 646 bp, Homo sapiens
  misc_feature: GYAE6OF02HTCQX.7.5.A05.1.454.CMB.1.raw
  modified_base (306)..(306): a, c, t, g, unknown or other
  misc_feature (306)..(306): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacgagggtcgtgggcccagtctgccctgactcagcctgcctccgtgtctcgggtctccgtggacagtcgatcaccatcctctgcactcggaaccacactgacgttgcttggttaataatacttctcttccgtgtactcaacaactaccgagacaacgcccaaagtcatctattangtatgtactatacgtccgtcttacggtagggttccatcgtcttctcgtagtcctacctagtctacggacgaccaccgcccttcccgacaccgtacttccgtcggtacgggcccttacggacgtcggtaagaacggacggacgtacttagtaactttaagttccgtagcttacgacgtactaacttacgtaacggtaccggacaacgtccgtaacgtcctaccgttcggttacgggtttcgggacgggaccggtaactacggtaccgtaccggttaccgaccgttacgtacccgaaccggaccgtaccggttcccgacccggttccccggtacgttacccg

SEQ ID NO: 151649 - DNA, 598 bp, Homo sapiens
  misc_feature: GYAE6OF02G3RBE.7.5.A05.1.454.CMB.1.raw
  modified_base (166)..(166): a, c, t, g, unknown or other
  misc_feature (166)..(166): n is a, c, g, or t
  modified_base (178)..(178): a, c, t, g, unknown or other
  misc_feature (178)..(178): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagcgtgtctctacacgaccggtgctcgatttagatagatagacgagggggggggtctcgaggaggcagcgctctcgggacgtctccacatggcctgggctctgctattcctcaccctcctcactcagggcaacgagggtcgtgggcccagtctgccctgactcngcctgcctcgtntctggtctccgtggacagtcgatcacntctcancatcgaccacatgacgtgcttgttaanaatgtctctcgtagtctacaacactacncgacaacgaccccaagtactactactatttacgngtacttcgtactaacgtactaccggtcttacggttacggttaactacgtctacgtttccncgtcgtcctactacgtcgtggtacaccggtacgtcctccgactacgtaccttcgtccgtcggtacctcgagtcaaggtagacggtacgtactggttaacttcgtacgtgcgtaacngttacactanccggagtccacggtnacgtctacggtacggtcgttacggcggacgactacgaaccgtcgaccgtacgtcgtaccgtacggacctaccggttcacccgtcccgtaggttaccc

SEQ ID NO: 151650 - DNA, 633 bp, Homo sapiens
  misc_feature: GYAE6OF02HVIGP.7.5.A05.1.454.CMB.1.raw
  modified_base (419)..(419): a, c, t, g, unknown or other
  misc_feature (419)..(419): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
tcagcgtgtctctacacgaccggtgctcgatttagatagatagacgagggggggggtctcaggaggcagcgctctcgggacgtctccaccatggcctgggctctgctattcctcaccctcctcactcaggcacagggtcgtcgggcccagtctgccctgactcacgcctcgccgtccgtgtcgtcgggtctccgtcggacagtcgatcacatctctgcacgtacgaaccacactcgacttgcttagtaactaatactctctccgtagtactacaactaactaccaggacaaaccgccctaaatcaatactaattagcgtatcgtactactacgtcgtcttacgtacggttacagttccgtcttactcgtgacctacgagtccgtacggacgaccgtaccggccctacctacgaaccttntaccgtcggttcgaccgtacgacggtactaaacggaacggtaacgtggtactaggttaaattaccgtacggtacagtacgtactacgaaactagacgtacgacacgtacacgcttaccgttacggttacgggttccgaacggggacaacgtcgtcggtaccgtaccgtacgtccgaacgccctaaccggngttcccnccgtacccgtcgtaacc

SEQ ID NO: 151651 - DNA, 706 bp, Homo sapiens
  misc_feature: GYAE6OF02I4ZNO.7.5.A05.1.454.CMB.1.raw
  modified_base (589)..(589): a, c, t, g, unknown or other
  misc_feature (589)..(589): n is a, c, g, or t
  modified_base (606)..(606): a, c, t, g, unknown or other
  misc_feature (606)..(606): n is a, c, g, or t
tcagcgtgtctctacacgaccggtgctcgatttagatagatagacgagggggggggggtctcaggaggcagcgctctcgggacgtctccaccagtggcctgggctctgctattcctcaccctctcactcgagggcacgaggggtcgtgggccctagtctcgccctgactcagcctgcctccgtgtcgtgggtcctccgtggacaggtcgactccacctactcctccgtgccacgtacggaacccacctaacgttcggaacgtttcgaccgttaaggtttaaataaaattactccttacgttccgtaaggtaactacaaaaccgtaaccgtaacccgagggaacccaaaacccgacccccgtaaaagtcctaacttacttaacgttttagtacggtacttacgttaacttaagtaacggttccggttccgttacggttacgggtttacacgttcgtacttctacgtcgtacctacctgtcgtcggaccgacgtacccgccttacccgacgtacctactcgtaccgtcggtccgtaacgtcgtacgtaggacggacgtaggtctacgtattacgttcagtactcgtactanacttagtacgacgccancgtacgactcgtagttacggggtcggacggacgacgtaggtccgtaacggtccgtagtacgaccgacgtacggtacggccctaccgtaccggtcgtaccg

SEQ ID NO: 151652 - DNA, 821 bp, Homo sapiens
  misc_feature: GYAE6OF02GRC65.7.5.A05.1.454.CMB.1.raw
  modified_base (395)..(395): a, c, t, g, unknown or other
  misc_feature (395)..(395): n is a, c, g, or t
tcagcgtgtctctacacgaccggtgctcgatttagatagatagacgaggggggggggtctcaggaggcagcgctctcgggacgtctccaaccatggcctgggctctgctattcctcacccctcctcactcgagggcacgagggtcgtcgggccctagtctcgaccctgactcacgtccgtgcctccgtgtcgtgggttcctccgtggacacgtaccgactccaccgtacttcctccgttagacctaacgtcggtaacccacctacgtaggtcgttacgacgttggttaaattaaactcgtaccttccttcgtaggtactactaaacgaacctaccccgtaggaacccgtaaaccacccccgtaacggttacaacgttaccgtaatttttaccggntaacggttccgtttaactaacgttaaaccgttccggggtcccgttttaaacggtaccggggttttaaccctaccggtccgttcgtttccgtacgttcgggttaccctaaccgtaacggtttcccggcggtaacccggaaccgttcccgtcccccgttaccggtacaccctacgtttccgtacggttcccggttacgaccggtaccggtagttaacggaaccggtaccggtcgtacccggttaagttaccgttaaaccgtttacgccgaccgttaacggtaccctaggttaactacccgtaacgggacgttaccggactacgacgaccgttcttaacggggttccgttagggaccgaagggaccgtagcccggtagtaccgcgttaccgcgacgtacccggacgtcccgtcccgtccgtacgtcccg

SEQ ID NO: 151653 - DNA, 776 bp, Homo sapiens
  misc_feature: GYAE6OF02JN641.7.5.A05.1.454.CMB.1.raw
  modified_base (85)..(85): a, c, t, g, unknown or other
  misc_feature (85)..(85): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
tcagcgtgtctctacacgaccggtgctcgatttagatagatagacagggggggggtctcgaggaggcagcgctctcgggacgtcnccaccatggcctgggctctgctattcctcaccctcctcactcagggcacagggtcgtgggcccagtctgccctgactcagcctggccctcgtgtctgggtctcctggacagtcgatcacntcctacctgacncgtaggaacccnccacgtgaaccgttgcgttaggttataaaatntcctctcgttcgtatcaactaactaccaggacaaacgccccctaaagtccattacatttanagtatcggtactagttaactccggtacttcgacgggtttcaagttctcttctcgtgacctacctatcgtgacgtacaccgtcctccgtcgactaccgttacgtccgttagggcctttaaccgcggtaccgttacggaaacggacggtacggtaccgttaggttaacttaacgtttaaccgtccggtaaccgtaaacgttccggttaaaccgttaaccgttaagttaacggtaccggtaaacgtacggcccggtttaaaccaccggttaacccgtttaccggtttaaacggggtttaccgggtaaccggggtaccgggtaaaccgggtaaccggtaacccgggttaaccgttacccgggttaacccggttacggttaacccggtaacccggtacccgggttaaacccgggtccccggttacccccggttacccccgggtaccggtttaacccccg

SEQ ID NO: 151654 - DNA, 669 bp, Homo sapiens
  misc_feature: GYAE6OF02GKOQX.7.5.A05.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (368)..(368): a, c, t, g, unknown or other
  misc_feature (368)..(368): n is a, c, g, or t
tcagcgtgtctctacacgaccggtgctcgatttagatagatagacagggggggggtcgtcaggaggcagcgttttctctcgggacgtctccaccatggccttggctctgctattcctcaccctcctcactcagggcacagggtcgtgggcccagtctgccctgctcagcctgcctccgtgtctgggtctccgtggcagtcgatcaccatctcngcatgaaccacnctgacgtgctggtaactaaatctctctctggtatacaactaataccaggacaaacgacccaaagtcaatactagttactgtatacgtacttaagtacgtcggtccctttagtacgggtttaccaattccgtcttactcgtcgntaccgtagtctgcgacacgtcctccgacgacactctcggtcgtccgtcgagtcgtagaacggaacgacggtacttagaacgtttacttaacgcgtacgaccgtacgttactaagttacgtaacgtaccgggtacgtaggacctacgtaccgtaacttccgggttacgtttaccggggacgggtaccgggaaaccgtacgggtaaccggtaccggtaacccggtttaaccgggacggttacccggaacgtaccccggaaacgggtccccgttaccccggtacccggttaccggttaaccccg

SEQ ID NO: 151655 - DNA, 702 bp, Homo sapiens
  misc_feature: GYAE6OF02H2OZK.7.5.A05.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (407)..(407): a, c, t, g, unknown or other
  misc_feature (407)..(407): n is a, c, g, or t
  modified_base (605)..(605): a, c, t, g, unknown or other
  misc_feature (605)..(605): n is a, c, g, or t
tcagcgtgtctctacacgaccggtgctcgatttagatagatagacgaggggggggggtctcagggaggcagcgctcgtcgggacgtctccaccatggcctgggctcgtgcttacttcctcacccttcctcactcgagggcacgtagggtcggtcgggacccagtctcgccctgacctgacgtcctcgcctcggtcgtcgtcgggtctccgaggacngtccgatccacnctctcngacacgtacgaaccacatcggtacgttgtcgttaagttaaataacttctctactccgtagtacaactaaacacgtaccaacggtacaaaacccacccgaaatcgtaactctaacgttctagtactgttactacgtatcccggtcgttaggtaccggttactacgtctcttacncgttcggacctaggtactccggtagaccgtacgtccggtccctaccggtacgtcactttccggcggacccggtccgtacggaaccggttacgaacggtaacgggtaaaccggagggttacttaacgggttccttaagttacccggagtaccgacgttctaaccgtaataacgttaccgaacacggtcaacggttaccnccggttaactacggtagggtccggacggacgtaccgtagtcccgtagcgttaactcggccgtaacgccggacctaccggttcccggccttacggtac

SEQ ID NO: 151656 - DNA, 766 bp, Homo sapiens
  misc_feature: GYAE6OF02GOZAQ.7.5.A05.1.454.CMB.1.raw
  modified_base (758)..(758): a, c, t, g, unknown or other
  misc_feature (758)..(758): n is a, c, g, or t
tcagcgtgtctctacacgaccggtgctcgatttagatagatagacgagggggggggttcgtcaggaggcagcgctctcgggacgtctccacatgcctgggctctgctattcctcaccctccgtcactcgaggcacagggtcgtggcccagtctgccctgactcagctgcctcgtgtcgtggtcctcctaggactaggtccgtactccgaccgtacttcctcctgacctaccgttacggaacccaccgtaccttcggtaccgttgccgttacggtttaaataacttactcttccttaccgtaggtaactaaccgtaaactaaccgtaccctaaggtaccgtaaacccgtaccccgaaagttcataccgttattttacgacgttacttacgttactagttaacgttaccgggtttccttaaccgggtaccgggtttaaccgagtttacccggtctttaccggttacgtcggttacctttaaccgttaggttaccgtcgggaaccgtaccggtaccccgtacccgttacccgtacggacccttacgttttcccaggtcccgaccgtcgacggttacgaggtacgacggtaggtcttacgtaagtttacttacggattcgtaacgtcaactacggtagacgtacgcgtaacgcttaccgtaacttccgggtacgtttgggccgtaaggacccggtagacgggttacccacggttaccgagtcgaaccgcgttaacccgccggttctaccccgggttacccgnggttaccc

SEQ ID NO: 151657 - DNA, 931 bp, Homo sapiens
  misc_feature: GYAE6OF02FN4ER.7.5.A05.1.454.CMB.1.raw
  modified_base (166)..(166): a, c, t, g, unknown or other
  misc_feature (166)..(166): n is a, c, g, or t
  modified_base (261)..(261): a, c, t, g, unknown or other
  misc_feature (261)..(261): n is a, c, g, or t
tcagcgtgtctctacacgaccggtgctcgatttagatagatagacaggggggggggtctcaggaggcagcgctctcgggacgtctccaccatggcctgggctctgctattcctcacccttcctcactcagggcacgagggtcgtgggcccagtctcgccctgactnagcctgcctccgtgtcgtgggtctccgtggacagtcgactcacctatctactcgcacgtcggaacccaccacgtgacgttgctaggttaataatntcttcctctgtactacaaacaataccccgaggacctaaaacgaccccccgtaaaagtccgatactaattttatagtaacgttcgtaacttacgtaaacgtttccggtccctttaacgggttaccggggttttaccgtaacttaccggttctttcccgttgttccggtaccttaccgtaaacgtcgttcgggaccgtaacccggtaccgggtacccctacccggttaccgtaccgtacgttcgttaccgggtcggtaccggtcccggtaggggtacgtaaaccggggtaaacgggtaaccggttaacgggggtaccctaagtttaaacgttttaaaccggtttaccggtaacggttacccgtaaaggtaaacccggttttacaaaacgggttttaaccgttaaaccggggaaggttaaccggggaaaccggttacccggtaaacgggtaccgtttaaacccgtttaacccggggggttttaaaccgggggtttacccgggggttaacgggggtaaccgggttaaccccggtaacggtttacccggttaaccccgggtaaccccgggttaacccgggtttaccggtaaacccgggtaaccggtaaccccccgggtaaggggttaccccctttaaccccccgggggttacccccgtaacgggtttacccccgg

SEQ ID NO: 151658 - DNA, 859 bp, Homo sapiens
  misc_feature: GYAE6OF02IVJV4.7.5.A05.1.454.CMB.1.raw
  modified_base (137)..(137): a, c, t, g, unknown or other
  misc_feature (137)..(137): n is a, c, g, or t
tcagcgtgtctctacacgaccggtgctcgatttagatagatagacgagggggggggtctcaggaggcagcgctctcgggacgtctccaccatcggcctgggctctgctattcctcaccctcctcactcagggcacgngggtcgtcgggacccagtctacgccctgactcgacgcctgccctccgtgtcgttggtctcgtggactgtcgactccacatcctctgacacgtacgaaccactacgtgtacgtgcgttaggtaataaactctcctcgtacgtggtactactacgaaactaacgtacccgaaggcctaaaaccgtacccctaaagtacctaacgttaccgttaaattttaggacgtacgttacgtaaaccgtttaaggtaaccggtccggtccttttaaaacgggggttaccgggtttaaacctaaccggttcttaccgttttccctacggtaacggtttcctaaaccgtaacggtttcgtaaccggggacctaacccgggacccggtaccctttacccgaaacggtttcccgtacgttccggtccggggtaccggtaccgtttaccggaaacggttaccgtacggggaaaccgggtaccggtaaggttaacccgttaacggtttaacgtttaaccggtaacgttaccgggacccgttaaactccgtaaccgttaagggtaaacttaccgaacgggtcggaaccgtctaaacgggttcgtaacccggttttaacggggttacggttaaccccgggagggtaacgtaaccgtacggtacccggtaccgggttacgttaccgtcggaaccgtaccggtacgaacccggttccgtccccgggtttaacctacccggg

SEQ ID NO: 151659 - DNA, 843 bp, Homo sapiens
  misc_feature: GYAE6OF02H7NOB.7.5.A05.1.454.CMB.1.raw
  modified_base (163)..(163): a, c, t, g, unknown or other
  misc_feature (163)..(163): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcngcctgcctccgtgtctgggtctcgtggacngtcgatcaccntctctgcactacggaaccacgactcggtacgttgtcgttaggttaactaaattagtaccttcttccgttaggtactacaactaaactaccgaacgacctaaacgccccgaaagttcaagtactagttttagtacggtattacggttacttaacgttaacgttccgttaccgtttcgggtaacgggtttacccgtaacgttccgttacctttcgtccggtacgggttaccttaccgtaaacgttccggttacgggaccgtaaaccggtacccgtcccgttacccgtaccgtaacccgtccgttaccgtttaccgggtcggttaccctacccgggttacgggtaccgtaacggaaaccgggttaaccggacggggtaccgtttacgggtttaattttaaccgggttacgttaacccggtcgaaccgtttaccgtaacgttaactaacggttaacgaccggttaaggtaacgacccggtacgacgttaacccgttcggggtttaaccggtttcccgggggaaccggtaccgggtaaccgtacgggttaccggacccgttttaaaccgggtccggttaaccgggttcccgaaacggtcccggtaaggttcccgtaccccgtccccgggttacgtttaccccgg

SEQ ID NO: 151660 - DNA, 859 bp, Homo sapiens
  misc_feature: GYAE6OF02G0TRA.7.5.A05.1.454.CMB.1.raw
tcagcgtgtctctacacgaccggtgctcgatttagatagatagacgaggggggggtctcaggaggcagcgctctcgggacgtctccaccatggcctgggctctgctattcctcaccctcctcactcgagggcacagggtcgtgggcccagtcgtgccctgactcagcctgcctccgtgtctgggtctcctggacagtcgatcgacatcctcctgcctacgtcggtaaacccaccgtacgtcggtacgttcggtccgttagggtttaaacttaaaacgttacgttcccttacccgttaccgtttagggttaacttaaccaaaaccgtaaacccttaacccccggaaagggaaccccgaaaacccgtaaccccccccgtaaaggttaccgtaacgttaacctaacttttagtacgtacttcggtactaattaacggtccggtccgtttacggtacgggtttaccaacttccggtaccttacgttccgtacggtacctaccgtaacggtccgttacgggaaccgacccgtaccgggtaccccctttacccgtaccggaacccgttacgtttaccccgttcggggtacccggttacccgtacccggtaacggtaccgtttaacgggaaccgttacggaaccggtagttacgtaacgtttagttaccgtacgacgttacgctttaacacttaacgaacggtacgtacgaccgacgttaacgccgttaacggtacgttaacggggtttacccgggacgggtaaccgggtaccgtaccgggttaccgtacccgttaaccggttaccgtaccgggtacaccggtaacccgacggttccccgtacccggttacccgtcgttaccccgg

SEQ ID NO: 151661 - DNA, 680 bp, Homo sapiens
  misc_feature: GYAE6OF02FRPV9.7.5.A05.1.454.CMB.1.raw
  modified_base (270)..(270): a, c, t, g, unknown or other
  misc_feature (270)..(270): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
  modified_base (433)..(433): a, c, t, g, unknown or other
  misc_feature (433)..(433): n is a, c, g, or t
tcagcgtgtctctacacgaccggtgctcgatttagatagatagacaggggggggggtctcaggaggcagcgctctcgggacgtctccaccatggcctgggctctgctattcctcaccctcctcactcgagggcacgagggtcgtgggcccagtctcgccctgactcacgcctgccctccgtgtcgtgggtcctcctaggacagtccgatccacctatcctcctgccactcggaacccaccgtactgacgttgtcttaggttaaataaatnttcgttctcctaggtaactctaaactaactacccgaaggacctaaaccgacccccgtaaagttcactactattanagtagtntactaatacgtccgtcttaggtacggttacagtctcttcnctgctacgacgtcgtaggacgacgccgtcctccacgtaccngtacgtcgtcggtctccgaacggtcgtaacggtaaacggacggtaccggtattagttaaaccgtttacgttacgtcgtaccttacggtacctacgtaaattaaccgtaacggtacgaccgaaccgacacggaaccgttcgtacgtttcggggttacgggacggtacgaccgtaagccgttaaccggtccgttacggtaccgttcgaccggtacccgtaggccctcccgggaccccgttacgtacccg

SEQ ID NO: 151662 - DNA, 776 bp, Homo sapiens
  misc_feature: GYAE6OF02G2W5J.7.5.A05.1.454.CMB.1.raw
tcagcgtgtctctacacgaccggtgctcgatttagatagatagacagggggggggtctcaggaggcagcgctctcgggacgtctccaccatggcctgggctctgctattcctcaccctctcactcagggcacagggtcgtgggcccagtctgccctgactcagtcctggcctccgtgtctgggtctccgtggacagtcgatccaccatcctcctgctaccgtcggaacccacctactggtacgttgaccttagggttaataaaatcgttctcgttaccgtgtatacaactaactaccgtacgacaaaccgacccccaaagtcactactaatttatgtactgtactaagtacgttccggtaccttcgggtacgggtttaccaacgttcgtacctttcgtacgtcggtaccctacgtacggtccgtacggtaccgaaccggtcccggtccccttacccgtacggtaccctacgtttacccggtcggttacccggggtcccgttaaccgggacgggttacggtaaaccgggtaaacgggtaccggacggggttaccgtaacggtttactttaaaccggttaaccggtgttacccgtacgtacccgtttaactaaacggttaccgtacccggtaaggaccgacgtacacggttacccgttacttaccgggttaacgggttaccgggacgggaacccggtacggtaagtcccgtacggtacgttacccggtagacccggtacgacccggtacgtaccctccggtaccccggtacgtacccg

SEQ ID NO: 151663 - DNA, 675 bp, Homo sapiens
  misc_feature: GYAE6OF02G12SA.7.5.A05.1.454.CMB.1.raw
  modified_base (306)..(306): a, c, t, g, unknown or other
  misc_feature (306)..(306): n is a, c, g, or t
tcagcgtgtctctacacgaccggtgctcgatttagatagatagacagggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaacccaccactgacgttgcttaggttataaatatctctcctggtatcaacaactacccaggacaaacgcccccaaagtcatctatttangatgtctaataacgtccggtccttcgtacggggtttacctaacgtcgtctttctcgtcggtcctacccgtaagtcgtcgggaccgacgacccggtcccttccccgtcgaccctattccgtcgtcggtcctccgacggtctaggaacggacggtacgcgttagtaatttacttaaccgtgaccgtacgtcctacaacttaacgtacgacgggaccaggaccgtaacgcctaacgttccggttaacgggtttccggggacgggaccgggaacctaacggccggttaccggtacccggttccgtaaccggtaccgaccggtaccccgtaaacgggtcccgttaccccggtaccccccggtacggttaccccg

SEQ ID NO: 151664 - DNA, 784 bp, Homo sapiens
  misc_feature: GYAE6OF02IWGOX.7.5.A05.1.454.CMB.1.raw
tcagcgtgtctctacacgaccggtgctcgatttagatagatagacagggggggggtctcgaggaggcagcgctctcgggacgtctccaccatggcctgggctctgctattcctcaccctcctcactcagggcacagggtcgtgggcccagtctcgccctagactcagcctgcctccgtgtcgtcgggtctcccgtggacctaggtccgatccaaccgtgtcctccgtgcacgtcggaacccacgactgacttgcttaggttaataatctctctccgtaggtactacgaaactaacgtacccgaaggtaccaaaccgaccccctaaagtacgtacctacgttaatttacgtacgtacttcgtaactaacgtacgttcccggtactttacggtaagggtttacctaacgttccggtactttaccgtcgttacgggtaccttaccgaacgttcgacggtaaccgacgtacccgggtccctaccctacgtacccgtatccgttgtccgggtacctaccggcggtacgttaacggacgaacggtcgggtcctaaggttacttacgttaccgtggaccctaatccgtacgtaagttaaccgtaccgtacggaccgtagtaccgtaacgcccttaaggttacccgggtttaacgggttaccgggaaccgggtacggtaaaacccgggtcgtacccggtaaccggtcccggttaacggttaacccggtaccgtacccggtacccgtaaccgggttcccgtttaaccccgttaccccggtccgttaaccccgg

SEQ ID NO: 151665 - DNA, 866 bp, Homo sapiens
  misc_feature: GYAE6OF02I51RJ.7.5.A05.1.454.CMB.1.raw
  modified_base (337)..(337): a, c, t, g, unknown or other
  misc_feature (337)..(337): n is a, c, g, or t
tcagcgtgtctctacacgaccggtgctcgatttagatagatagacagggggggggtctcaggaggcagcgctctcgggacgtctccaccatggccctgggctctggctattcctcaccctcctcactcagggcacagggtcgtgggcccagtctgccctgactcagcctgcctccgtgtcgtcgggtcctcctggacaggtcgactcacctatcctcctgaccacgtcggaaacccaccctacgtcgtaccgttgcgttaggtttaataaaatacttcctctcgtgtatacaacaactaccgagaccaaaccgacccctaagtctatactactttanagtatgtactaattaacgtccgtccttcggtacgggtttacctaagtcgtcttcgtctcggtcctaccgtacgtcgtacggaccgtaccgaccggtcccctacccgtacgtaaccctacgttccgttccggtcgggtccctacccgggtacggtaccggtaacggtaaacgggtccggtaacgggttaccgttaaggtaaaccttttaaaccggttaccggtacgtaacccgtacggttaacccgttactaaccgtttaaacgtaaacccgggtacggtaaccggtaccggaaaccgttaacccgggtaaccgttaacccggttaaacccgggttttaacccggggggttttaaccgggggaacccgggggtaaacccggggttaaacccgtaaccgggttaacccgttaaccccggggtaaccccggttttaaacccgggaccgggtttaacccccgaaccgggttaaccccggaacccggggtttccccgtacccccggttacccccggttaacccggttacccccg

SEQ ID NO: 151666 - DNA, 154 bp, Homo sapiens
  misc_feature: GYAE6OF01DXHX8.10.30.C08.1.454.CMB.1.raw
  modified_base (154)..(154): a, c, t, g, unknown or other
  misc_feature (154)..(154): n is a, c, g, or t
tcagcatagtagtgcacgaccggtgctcgatttagtctgacgtcaaagggaaagggaccaaggtggaaatcaaacgaactgtggctgcaccatctgtcttcatcttcccgccatctgacactactatgctgagcgggctggcaaggcgcatagn

SEQ ID NO: 151667 - DNA, 154 bp, Homo sapiens; identical to SEQ ID NO: 151666
  misc_feature: GYAE6OF01A76QK.10.30.C08.1.454.CMB.1.raw
  modified_base (154)..(154): a, c, t, g, unknown or other
  misc_feature (154)..(154): n is a, c, g, or t

SEQ ID NO: 151668 - DNA, 153 bp, Homo sapiens
  misc_feature: GYAE6OF01BYKBB.10.30.C08.1.454.CMB.1.raw
tcagcatagtagtgcacgaccggtgctcgatttagtctgacgtcaaagggaaagggaccaaggtggaaatcaaacgaactgtggctgcaccatctgtcttcatcttcccgccatctgacactactatgctgagcgggctggcaaggcgcatag

SEQ ID NO: 151669 - DNA, 155 bp, Homo sapiens
  misc_feature: GYAE6OF02GHWE8.10.30.C08.1.454.CMB.1.raw
  modified_base (154)..(155): a, c, t, g, unknown or other
  misc_feature (154)..(155): n is a, c, g, or t
tcagcatagtagtgcacgaccggtgctcgatttagtctgacgtcaaagggaaagggaccaaggtggaaatcaaacgaactgtggctgcaccatctgtcttcatcttcccgccatctgacactactatgctgagcgggctggcaaggcgcatagnn

SEQ ID NO: 151670 - DNA, 154 bp, Homo sapiens; identical to SEQ ID NO: 151666
  misc_feature: GYAE6OF02G6IYC.10.30.C08.1.454.CMB.1.raw
  modified_base (154)..(154): a, c, t, g, unknown or other
  misc_feature (154)..(154): n is a, c, g, or t

SEQ ID NO: 151671 - DNA, 169 bp, Homo sapiens
  misc_feature: GYAE6OF01B2SGI.4.5.A05.1.454.CMB.1.raw
  modified_base (149)..(169): a, c, t, g, unknown or other
  misc_feature (149)..(169): n is a, c, g, or t
tcagagcactgtagcacgaccggtgctcgatttagatagatagacaggggaccaagctggagatcaaacgaactgtggctgcaccatcctgtcttcatcttcccgccatctgactacagtgctctgagcgggctggcaaggcgcatagnnnnnnnnnnnnnnnnnnnnn

SEQ ID NO: 151672 - DNA, 149 bp, Homo sapiens
  misc_feature: GYAE6OF01BGMHX.4.5.A05.1.454.CMB.1.raw
  modified_base (148)..(149): a, c, t, g, unknown or other
  misc_feature (148)..(149): n is a, c, g, or t
tcagagcactgtagcacgaccggtgctcgatttagatagatagacaggggaccaagctggagatcaaacgaactgtggctgcaccatctgtcttcatcttcccgccatctgactacagtgctctgagcgggctggcaaggcgcatagnn

SEQ ID NO: 151673 - DNA, 148 bp, Homo sapiens
  misc_feature: GYAE6OF01CC8OT.4.5.A05.1.454.CMB.1.raw
  modified_base (148)..(148): a, c, t, g, unknown or other
  misc_feature (148)..(148): n is a, c, g, or t
tcagagcactgtagcacgaccggtgctcgatttagatagatagacaggggaccaagctggagatcaaacgaactgtggctgcaccatctgtcttcatcttcccgccatctgactacagtgctctgagcgggctggcaaggcgcatagn

SEQ ID NO: 151674 - DNA, 148 bp, Homo sapiens; identical to SEQ ID NO: 151673
  misc_feature: GYAE6OF01AOEAR.4.5.A05.1.454.CMB.1.raw
  modified_base (148)..(148): a, c, t, g, unknown or other
  misc_feature (148)..(148): n is a, c, g, or t

SEQ ID NO: 151675 - DNA, 151 bp, Homo sapiens
  misc_feature: GYAE6OF01D0VV1.4.5.A05.1.454.CMB.1.raw
  modified_base (147)..(151): a, c, t, g, unknown or other
  misc_feature (147)..(151): n is a, c, g, or t
tcagagcactgtagcacgaccggtgctcgatttagatagatagacagggaccaagctggagatcaaacgaactgtggctgcaccatctgtcttcatcttcccgccatctgactacagtgctctgagcgggctggcaaggcgcatagnnnnn

SEQ ID NO: 151676 - DNA, 148 bp, Homo sapiens
  misc_feature: GYAE6OF01B37XE.4.5.A05.1.454.CMB.1.raw
  modified_base (146)..(148): a, c, t, g, unknown or other
  misc_feature (146)..(148): n is a, c, g, or t
tcagagcactgtagcacgaccggtgctcgatttagatagatagacagggaccaagctggagatcaaacgaactgtggctgcaccatctgtcttcatcttccgccatctgactacagtgctctgagcgggctggcaaggcgcatagnnn

SEQ ID NO: 151677 - DNA, 148 bp, Homo sapiens; identical to SEQ ID NO: 151673
  misc_feature: GYAE6OF02HOKH6.4.5.A05.1.454.CMB.1.raw
  modified_base (148)..(148): a, c, t, g, unknown or other
  misc_feature (148)..(148): n is a, c, g, or t

SEQ ID NO: 151678 - DNA, 663 bp, Homo sapiens
  misc_feature: GYAE6OF01ERTYL.9.38.D05.1.454.CMB.1.raw
  modified_base (373)..(373): a, c, t, g, unknown or other
  misc_feature (373)..(373): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtaattaactatgtctcctcggtaaccaaacaactaccccggacaaaaccgcccccaaacttcttagtctttatgatgtctagttatccggccctcgaggtagtttctgtatcgcttctctggcctcaagtcnggcacccgacggccctccctcgacctactctcgtcggctccgagcgtagacggtacgacgtcgtgtatttntttcgtgcgagactaanaaaacggtagtacgtcccgttacgttcgggttacgggttttccggggaaccgggggtaccgtaagggtccgtaacccgttaccggttaacgtaccgtaacggaccccgtaaacgggtcccgtcccggtcccccgtacccgggttaccctacccgttcccgttacccgttaccccctacccccgttaccgtccggtaaaccgg

SEQ ID NO: 151679 - DNA, 677 bp, Homo sapiens
  misc_feature: GYAE6OF01D287F.9.38.D05.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (425)..(425): a, c, t, g, unknown or other
  misc_feature (425)..(425): n is a, c, g, or t
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcttgggcccagtctgccctgactcagcctgcctcgtgtctggtctcctggacnggtcgtagccatctcctgcacgtggaaactacagtgtacgttggtnactttaataattntgtctcgtgtactacaacaacaccgaggacaaaccgcccccaactctaatttatttcngatgtacaacaacgtcccggaccctaggtactttcgagtacgtcgttccttcgtcgtcggtctaccgaagtccgtacggaccaacgtaccggcccctccgtacgaaccctntccgttacgtcgggtccgtccggcgttggaacggacggacggtactaccgtaacttacgttacgtcgcgtacgtcctacaattacgaaccaaccgacgccgtaactaccgttaccgttggtttcgggtacgggacgggtaacgacgtaccgtaaacgtcccggtaccgttaccggttaacggtccgaacccggtacccggtaacgtccccgtaccccggtccccgttaccggtccctaacccgtttccccgg

SEQ ID NO: 151680 - DNA, 632 bp, Homo sapiens
  misc_feature: GYAE6OF01EIFIS.9.38.D05.1.454.CMB.1.raw
  modified_base (446)..(446): a, c, t, g, unknown or other
  misc_feature (446)..(446): n is a, c, g, or t
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaaccaacaataccccggcaaaacgccccaaatcttgctttatgatgtactagttatccggccctcgaaggtacgtttctagtatcgtcttctctggctacaagtctcggcaccacggcctccctgaaccatctcgtcgggtctccgaagcgtggacggtacggaaggtctagtattatttacgtntacgacgtactaacgaaaaacgtagtacgccgttacgtcggttgggttttaccgggacgggggtacctaagggtacgacccgtacgtaaggtccaacggtacccgaaggtcccgttacggccccccgttcgggtacctaaccgttccgttaccgttacccccctacccgttcccgtcgtaaaccgg

SEQ ID NO: 151681 - DNA, 311 bp, Homo sapiens
  misc_feature: GYAE6OF01BTRQL.9.38.D05.1.454.CMB.1.raw
  modified_base (172)..(172): a, c, t, g, unknown or other
  misc_feature (172)..(172): n is a, c, g, or t
  modified_base (288)..(288): a, c, t, g, unknown or other
  misc_feature (288)..(288): n is a, c, g, or t
  modified_base (291)..(311): a, c, t, g, unknown or other
  misc_feature (291)..(311): n is a, c, g, or t
tcagtgatacgtctcacgaccggtgctcgatttagtatctgatagttgggtttgggaacctatgaacattctgtaggggccactgtcttcaccacggcctccctgaccatctctgggctccaggctgaggacgaggctgattatttctgcagctacaaaagaagtagccctntcgtggtttcgcgggggacaaggtgacgtcctaagtcagccaaggctgccccctcggtcactctcgttcccacctcctcagacgtatcactgagcgggctggcaaggcgacatagngannnnnnnnnnnnnnnnnnnnn

SEQ ID NO: 151682 - DNA, 719 bp, Homo sapiens
  misc_feature: GYAE6OF01A596T.9.38.D05.1.454.CMB.1.raw
tcagtgatacgtctcacgaccggtgctcgatttagtatctgatagttgggtttggggggggtctcaggaggcagcgctctcgggacgtctccaccatggcctgggctctgctattccctcaccctcctcactcagggcacagggtcctggacccagtctgccctgactcaacctgcctcgtgtctgggtctcctggacagtcgatcaccatcctcctgcacgtcggaaccagcagtgactattaggtattaactgtcgtcctccgttaggtaaccaaactaactacccccggactaaaccgaccccctaaacttcttgtacctttaatgattcgtacgtacgtttactccggtccctcgaggtacgtttccgtgtactccggtcttacgtcgtcgtcctactaaggtcgtacggaccacccggtaccggtcccttaccgtcgaccctacttccgtcgtcgggtcctccggacggtcgtacggacgggtacgacgggtctaggttaactttactttcgtacgtactacgtacgtaaaccgaaaagtacgtacccgacccgtttcggttaccgggtttacggggtttaccgggggaaccggggttaacgtacgggtaccgtaccggtccgttaacggtccgtaccgacccggtacgtcccgtacccggtccccgtcgtaccctacgtcccttaccgtacccctccttcccgcgtaacccgg

SEQ ID NO: 151683 - DNA, 761 bp, Homo sapiens
  misc_feature: GYAE6OF01A87IB.9.38.D05.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagtgatacgtctcacgaccggtgctcgatttagtatctgatagttggggtttggggggggtctcaggaggcagcgctctcgggacgtctccaccatggcctgggctctgctattcctcaccctcctcactcagggcacgagggtcctggacccagtctcgccctgactcaacctgcctcgtgtctgggtctctggacagtcgatcaccntctctgcacgtacggaaccngcagtgactagttacggttaattaactntcgtctaccgtggtaaccaacgaaacgtaccccggacaaaccgaccccctaaacttccttcggtactttatcgtattgtacgtagttacgtccggtaccctgtacggttagtttactcgtactcgttccttcgttcgtcgctactagtcgtacggacctacccgaccggtcccctccgtacgtaacctacgttccgttccggtccgggacctccggacggtcgttaacgggacgggtaccgtagggtcttaggttaacgtttacgtttccgacgtaccgtaagtaaccttaaacgaaaaaggtaccgtacggtccccttacgggttccgggtttacggggtttaccgggggtaccggggtaaaccggttaccgggtaccggttaacccggttaccgttaacggtccgaaccggtcccgggaacgttcccggtcccgtacccccggttcgtaaccctcccgttcccgttacccgttacccccgcccttaccgccgtaacccgg

SEQ ID NO: 151684 - DNA, 776 bp, Homo sapiens
  misc_feature: GYAE6OF01CCZQX.9.38.D05.1.454.CMB.1.raw
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcacgtaggaaccagcaggtgactattggtacttaactagtgtcctcgtacggtaaccaactaacgtacccccggacaaaccgaccccctaaatcttcgtactttatgattgtctagttacgtccggaccctgacggttagtttctgtactcgtactttcgttcgttacgccttaccgtaagttccgtcggacccgacccgaccggtcccctccctaggacccttacgtccgtccggtcgggaccctaccggtacggacgttagggaccggtacggtaggtccgttaagtacttttacgttcgaggacctaaggtaaccgtaaacgtaaaaggtacccgttaccggtaccccgtttacgggtttcgggtttaccgggggtttccggggaaccgggggttaacccgttagggtacccggttacccggttaaccgttaagtcccggtaacccggtaacccggtaacggtccccgttaccccggtaccccccggttaccggttacccgttacccttcccggttaccccggttaccccctcccttacccgttccggtaacccgg

SEQ ID NO: 151685 - DNA, 828 bp, Homo sapiens
  misc_feature: GYAE6OF01CQBES.9.38.D05.1.454.CMB.1.raw
  modified_base (240)..(240): a, c, t, g, unknown or other
  misc_feature (240)..(240): n is a, c, g, or t
tcagtgatacgtctcacgaccggtgctcgatttagtatctgatagttggggtttggggggggtctcaggaggcagcgctctcgggacgtctccaccatggcctgggctctgctattcctcaccctcctcactcagggcacgagggtcctggacccagtctcgccctgactcaacctgcctccgtgtcgtgggtctcgtggacagtcgatcaccatctcctgcacgtaggaccagcaggtnactattaggtaattaacttatagtcttccgtaggtaacccaaacaacctacccccggaacaaaaccggaccccctaaaacttccttaggtacttttacgtagtaacttacgttaccgtaacggtttaccgtaacccgggtccccctttagaacggggtttaacgttttaccgtacgggttaacttcccggttccgttttccgtccgggttcggtaacccctaaccccggttaaacgttccggttaacgggcccctaacccggtaacccgggtcccctaccccgtagtacccccgtatttccggtccggtaccgggaccgttaccggaccggttacgtacggaacgggtaccggacggtacgttagttacgttttacgttcgtacgtacggtactacgtactacgttaacttcggtcgttacgggtttccggttttaacccgtttgttaaccttaagttacggttacgtaccggggacgggtacccggtacggtacgggtcgtacccggtaccgtttacggtaccggtacgtaccgtaccggtaccggtaaacccgcccggtacccccgtcccgttccggtaacccccg

SEQ ID NO: 151686 - DNA, 315 bp, Homo sapiens
  misc_feature: GYAE6OF01BKF6F.9.38.D05.1.454.CMB.1.raw
  modified_base (173)..(173): a, c, t, g, unknown or other
  misc_feature (173)..(173): n is a, c, g, or t
  modified_base (303)..(315): a, c, t, g, unknown or other
  misc_feature (303)..(315): n is a, c, g, or t
tcagtgatacgtctcacgaccggtgctcgatttagtatctgatagttgggtttgggaacctatgaacattctgtaggggccactgtcttcaccacggcctccctgaccatctctgggctccaggctgaggacgaggctgattatttctgcagctacaaaaagaagtagccctntcgtggttttcggcgggggaccaaggtgaccgtctaagtcagccaggctcgcccctggtcactctcgttccccaccctcctcagacgtatccactggacggcgggtctcgggactaagggccgacatagnnnnnnnnnnnnn

SEQ ID NO: 151687 - DNA, 815 bp, Homo sapiens
  misc_feature: GYAE6OF01CB8CL.9.38.D05.1.454.CMB.1.raw
tcagtgatacgtctcacgaccggtgctcgatttagtatctgatagttgggtttggggggggtctcaggaggcagcgctctcgggacgtctccaccatggcctgggctctgctattcctcaccctcctcactcagggcacgagggtcctggacccagtctgccctgactcaacctgcctccgtgtctgggtctccgtggacagtcgatcaaccatcctcctgccacgtacggaaccagcagtagactagttggtaattaactatcgtctccgtaggtaaccaacaacgtaccccggacaaaccgaccccctaaaacttccgttacgtaccttttaagtcgtaagttgtaccgtacgtttaaccgtccccggccccttagtaagggttacgttttaccgtaggtaccttaccgttccgtttccgttccgttcggaccttaacccgtaaggttccgtaccggtaccccaacccgtaacccggtccccttaccccgtacgtaaccctacgtttccgttccggttcgggtcccgttacccggaaggtccgttacgggaaacgggtaccggaacggttaccgttagttaattttacgttcgtacgtaaccgtacgtaaaccgtaaaagtaaaaacggttaccgtacccgtcccgttaggttaccgggtttcggggtttaccggggaacggggtaaccgtacggttacggtaacccgtccgtaagtaccgccgtaaccggtacggtccctcccggtacccccgttcggtacccttaccgtcccgttaccccttacccccgtacccgttcgtaccggtaaccg

SEQ ID NO: 151688 - DNA, 672 bp, Homo sapiens
  misc_feature: GYAE6OF01ALNMO.9.38.D05.1.454.CMB.1.raw
tcagtgatacgtctcacgaccggtgctcgatttagtatctgatagttggggtttgggggggggtctcaggaggcagcgctctcgggacgtctccaccatggcctgggctctgctgctcctcaccctcctcactcaggacacagggtcctgggcccagtctcgccctgactcagcctgcctcgtgtcgtgggtctcgtggacagtcgatccacactcctcctgcacgtagaaccagcagtgagttggtaggtattctcgtacttcgtcctaccgtacggtaaccaacgacgaccgaccgacggaaccaaacccgacccctaaatctaatactaagtttagcggtaacgtaccaagtaccggccggtccttacggttacgggttttctacgtttcgtcctttcgtccggtacgtaccttaccgtaaggttccaaccggtaaccacccgtacccggtcccttaccggtaactacgtacttccgtcgtcggtcctcggtacgcggtacggacggacggtacgtctaggttaactttacgtacgtacgtcgttacgtactataagtacgtagacgtaggtcgtacggtactaccgtcggttccggttaggtcggtcgggacggtacggtacgacggtcgtaccgtcgtacgacgacggaccgcgtccgtccgtcccg

SEQ ID NO: 151689 - DNA, 836 bp, Homo sapiens
  misc_feature: GYAE6OF01BLA56.9.38.D05.1.454.CMB.1.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagtgatacgtctcacgaccggtgctcgatttagtatctgatagttgggttggggggggtctcaggaggcagcgctctcgggacgtctccacatggcctggctctgctattcctcaccctcctcactcagggcacgagggtcctggacccagtctgccctgactcaacctgccttccgtgtctgggtctactggacagtcgatccacctactcctcgtgacacgtacgaccngactagtacgacttagttgtaacttaactntcgtctcgtaccgtaacaacaccgtacccgacaaccgaccctaagtctacgttcttagacgtacttcgtacgtcgttacgtacccggacctacggaggtttacttctagtaccgttccgtcttccgtcgttggacccctagtacggtcgtacgtcccgtaccgcccggtccctaccggactaaccttcggtccgtccggtcgtaacccctcgggaccgtcgggtacggtaaacgggctaacgggtctaacgtttaacttcgggttcctacggaacgttaacaaccgtttaaaaccggaaagttccggtaacccttcccgttacggggttttaggggtttacccccggggtaagggggtacccgggggttaaacccttacgggggtccccgttaaaacccggttaccggtaaacggttcccgaaaaccccgggtttccgggaaaccccgtttccccgggtacccccgggttaacccggttttaccccgtaaccccgggttccccgttcccccggttttacccccggggaacccccttttcccccctaaacgggttaaacccgttaaccccgggg

SEQ ID NO: 151690 - DNA, 863 bp, Homo sapiens
  misc_feature: GYAE6OF01BE7KX.9.38.D05.1.454.CMB.1.raw
  modified_base (136)..(136): a, c, t, g, unknown or other
  misc_feature (136)..(136): n is a, c, g, or t
  modified_base (149)..(149): a, c, t, g, unknown or other
  misc_feature (149)..(149): n is a, c, g, or t
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (535)..(535): a, c, t, g, unknown or other
  misc_feature (535)..(535): n is a, c, g, or t
  modified_base (825)..(825): a, c, t, g, unknown or other
  misc_feature (825)..(825): n is a, c, g, or t
tcagtgatacgtctcacgaccggtgctcgatttagtatctgatagtttgggtttggggtacgatttgatgttacctgatgcttagaggtcttttcctggaagcgagggctattttgttgcttcagcaccgtagtcncctcgtcatcacnctcngtccttgtacttttccggatttcgaccgtacggaaaaccngacctacaccgacgttaaaccggaccaccgtcgacccgacaanatcgtccttccgtcccgtcccctgctaagtaaccacgaagtacaagtaacttaacgttaccttgttacccataccgtactaccgttccgttccggccttccggtaccggtttacggggcctaaccgtcccctacccctacggtaccccgttaacgtttaacgggtcggaaacggtaaccggttaacccttttccgggttccggtacccgggtcggtacgggttcccgggtttaccttttccgaacccggtttctttaacgttccggtttaacttgtcgtactaaccgtctcggttaccncctttacctacgttacgtacccttaacctccggacttacctacgttccgtaccttaaccaccggtaaactccctaaacccgtcccttaggaacctacccgggtaactttaaccgaaccggttaccctccccctaacccgtaaccccaaacgaacctaaccgttaacgtaccggtcccttccgaccgtaaccgccgggttacacgtttccgggtaccggttacgtcggtttaccggttttaccggtttacccccgttaccgtttcccgtaccgtttccccgtaaccccttnttaaacccggttcgtaacgtaaacggttccgttaaccg

SEQ ID NO: 151691 - DNA, 300 bp, Homo sapiens
  misc_feature: GYAE6OF02GHJ2W.9.38.D05.1.454.CMB.1.raw
  modified_base (291)..(300): a, c, t, g, unknown or other
  misc_feature (291)..(300): n is a, c, g, or t
tcagtgatacgtctcacgaccggtgctcgatttagtatctgatagttgggtttgggaacctatgaacattctgtagggccactgtcttcaccacggcctccctgaccatctctgggctccaggctgaggacgaggctgattatttctgcagctcaaaaagaagtagccctctcgtggttttcggcgggggaccaaggtgaccgtctaagtcagcccaaggctgccccctcggtcactctgttccccaccctcctcagacgtatcactgagcgggctggcaaggcgcatagnnnnnnnnnn

SEQ ID NO: 151692 - DNA, 300 bp, Homo sapiens
  misc_feature: GYAE6OF02G8T3O.9.38.D05.1.454.CMB.1.raw
  modified_base (291)..(300): a, c, t, g, unknown or other
  misc_feature (291)..(300): n is a, c, g, or t
tcagtgatacgtctcacgaccggtgctcgatttagtatctgatagttgggtttgggaacctatgaacattctgtagggccactgtcttcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctcagacgtatcactgagcgggctggcaaggcgcatagnnnnnnnnnn

SEQ ID NO: 151693 - DNA, 296 bp, Homo sapiens
  misc_feature: GYAE6OF02FOM15.9.38.D05.1.454.CMB.1.raw
  modified_base (293)..(296): a, c, t, g, unknown or other
  misc_feature (293)..(296): n is a, c, g, or t
tcagtgatacgtctcacgaccggtgctcgatttagtatctgatagttgggtttgggaacctatgaacattctgtaggggccactgtcttcaccacggcctccctgaccatctctgggctccaggctgaggacgaggctgattatttctgcagctcaaaaagaagtagccctctcgtggtttcggcgggggaccaaggtgaccgtcctaagtcagcccaaggctgccccctcggtccactctgttccccaccctcctcagacgtatcactgagcgggctggcaaggcgcatagnnnn

SEQ ID NO: 151694 - DNA, 650 bp, Homo sapiens
  misc_feature: GYAE6OF02GDMND.9.38.D05.1.454.CMB.1.raw
tcagtgatacgtctcacgaccggtgctcgatttagtatctgatagttgggtttggggggggtctcaggaggcagcgcgtctcgggacgtactccaaccaatggcctgggctctgctattcctcaccctcctcacctcagggcacagggtcctggaccagtctgccctgactcaacctgcctccgtgtctgggtctcctggacagtcgatcaccatctcctgcactggaaccagcagtgacattggtattaactatgtctcctggtaccaacaactaccccggcaaaacgcccccaaactcttgctttatgatgtcagttatcggcctcaggatttctgtactcgtcttctctcggctccaagtctggcaccgacggccctccctagacccatcctcgtcgggtcctccgacggctcggaggacgaggtctagtatttatttctcgactagtacctaacaaaaacggtaacgtaacgtcccttacgttccggtttcggggttttaccggggaccggggggtaaccgtaagggttccgaaccgttaccgtaacgtacgaacggacccgtaacgggtcctccggtacccccgttcgggtaccctaccgttccgttacccgttaccccctaccccgttccctaccgtaacccgg

SEQ ID NO: 151695 - DNA, 617 bp, Homo sapiens
  misc_feature: GYAE6OF02HDV32.9.38.D05.1.454.CMB.1.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (295)..(296): a, c, t, g, unknown or other
  misc_feature (295)..(296): n is a, c, g, or t
tcagtgatacgtctcacgaccggtgctcgatttagtatctgatagttgggtttggggggggtctcaggaggcagcgctctcgggacgtctccaccgatggcctgggctctgctattcctcaccctctcactcagggcacagggtcctggacccagtctgccctgactcaacctgccttccgtgtctgggtctcctggacagtcgatccaccatctcctgcactggaaccagcagtnacattggtattactntntctctgtaccacactacccgnaacgccccaaatctgctttannatgtcagttacgtccgggaccctcgaggtagtttctagtacttaccgtctttactcgttcggaccttaccgtaacgttcgtcgtaccacccgaccggtcctccgtacgacctactcctacgtcgggtcctacgaggtcgtggacggtacgagctagtattacgttcgtcgcgacgctaaagtaaagtcgtacgtccttcgtcgttgggttccgggacggggactacgggtcgtaccgtacgtaagtccgacgtccgacggtcctaccgtcccgtcggtacctacgttccgtcccgttaccccaccgttaccgacgtaaccg

SEQ ID NO: 151696 - DNA, 297 bp, Homo sapiens
  misc_feature: GYAE6OF02IAP1G.9.38.D05.1.454.CMB.1.raw
  modified_base (294)..(297): a, c, t, g, unknown or other
  misc_feature (294)..(297): n is a, c, g, or t
tcagtgatacgtctcacgaccggtgctcgatttagtatctgatagttgggtttgggaacctatgaacattctgtaggggccactgtcttcaccacggcctccctgaccatctctgggctccaggctgaggacgaggctgattatttctgcagctacaaaaagaagtagccctctcgtggttttcggcggggggaccaaggtgaccgtcctaagtcagcccaaggctgccccctcggtcactctgttcccaccctcctcagacgtatcactgagcgggctggcaaggcgcatagnnnn

SEQ ID NO: 151697 - DNA, 634 bp, Homo sapiens
  misc_feature: GYAE6OF02IED4B.9.38.D05.1.454.CMB.1.raw
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
tcagtgatacgtctcacgaccggtgctcgatttagtatctgatagttgggtttggggtacgatttgatgttacctgatgcttagaggtcttttcctggaagcagggcatttgttgcttcagcaccgtagtgcctcgtcatcacgcctcagccttgatttttccggatttgcctaggaaaaccagcctacacgtacttaaaccgggacaaccgtcgcccggaccaacatacgccttcctccgtcccccttgcagtaacaccaagtacaggtaatacttaactcgtttccatcgactacgtcctttcgctcgcgttagggtcactcacctcgccctattacgtgacagaccttgtctcggcgngcggtctttcgaccgtnttctcgttattatgtcanctattcgctacttcagtactcctcgacnctatcacctcgactacgcaacctacttccgaagtacgtccttaacgacgtaacgccctaaccctaaccaactaacgacaaacgtaacgccgtcgtaccctacgccgtacacgtccgtttcgggactacggttacgttaccgggtttacccgtccccggtttaataccgtttcccgtacccgcttacgtaccaacggttaacagtttaccc

SEQ ID NO: 151698 - DNA, 851 bp, Homo sapiens
  misc_feature: GYAE6OF02GKPZ7.9.38.D05.1.454.CMB.1.raw
  modified_base (250)..(250): a, c, t, g, unknown or other
  misc_feature (250)..(250): n is a, c, g, or t
tcagtgatacgtctcacgaccggtgctcgatttagtatctgatagttggggtttggggggggtctcaggaggcagcgctcgtcggggacgttctccaccatggcctgggctctgactattcctcaccctcctcactcgagggtcacgagggtcctggtacccagtctcgcccttgactcaacctgccttcgtgtcgtgggtcctcgtggactggtcgatccaaccatcctcctggctacgtacgaaccgngcacgtagacttagtttcggacgtactttaacgtaacgtcgttacttcccgtaccgttacggtaacctaaccgacgacctacccgaagggtaacctaaaaccccggttaccccaaaaacgttccgtaagttacggttaaacttttacggtacggtaaagggtaactaaaacgggtacggtacccgggttaccccgtttagggttaccggggttacccttaggttccgaccgtttccgtttcgtacgttacggtaccttaccgtaacgttcgtacggtaacctaccggtacccgtacccgtcccgtaacgtaccgtttcgttaccggtacgggtcccttacccggacggtaccgtacgtaccggtacgtacgaacggttctaagtttaacgttacgttttaccgacgaccgttaacgtacctacgttacgtaccgttacgaccgtaccggaaccgtaaccgtaacgttactttacggtaacggttacgggtaacgggtaccggtaccgtaaccgggttaccgtaacccggttaactaccgggttaccgtaaaccggtacccggaaccgtaccccgggtaaccccttacggtaccgttaaccg

SEQ ID NO: 151699 - DNA, 854 bp, Homo sapiens
  misc_feature: GYAE6OF02JOJ34.9.38.D05.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (577)..(577): a, c, t, g, unknown or other
  misc_feature (577)..(577): n is a, c, g, or t
tcagtgatacgtctcacgaccggtgctcgatttagtatctgatagttggggtttgggggggggtctcgaggaggcagcgctctcgggacgtctccaccatcggcctgggctcgtgctattcctcaccctcctcactcgaggcacgtagggtcctggacccagtctgcctgactcacctgcctcgtgtcgtcggtcctccgtaggactgtcgactcacattcctccgtgctacgtgaaccngtcaggttanactagttggtaacttaagtntcgtactcgtacggtaaccaacgaaccgttaccccggaacaacccggtacccctaaacttcttacgttactttactaggtacgttcggttaaccgtacgtttaccgtacccggttaccgttaacggtaggtttaacgttttaccggcgttacgttccccgtttcgttaccgttcggtcggttacccgtaacgtttacggttccgaaccggggtacccttaacccggcccgtttccccgtaacgttaaccgaaaccgttccgttcgttccggtcgtaccgtaccgtacggcgtacggacgggtaacgnggttaacgttacgttaacgtttacgttggtaacgtcttaacggtaactaacgtaaaacgggttaccgtaccgttaccggtttcggttaccgggttttccggggtaacggggtaaccgggttaccgtaaacgggttccgttaaacggttacgtaaccggttaccggtaaccggtacggtaccccgggtcgttaccccgggtaccccgtttaccgggaactttccccggtttaccgtaccccgttacccccgtaaccggtttaccgacccggttaaccg

SEQ ID NO: 151700 - DNA, 688 bp, Homo sapiens
  misc_feature: GYAE6OF02GZL3N.9.38.D05.1.454.CMB.1.raw
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagtgatacgtctacacgaccggtgctcgatttagtatctgatagttgggtttaggggtacgatttgatgttacctgatgcttagaggcttttacctggaagcagggcatttgttgcttcagcaccgtagtgcctcgtcatcacgcctcagtccttgatttttccggatttgcctaggaaaaccagcctacacgacttaaaccgggacaaccgtccgcccgccaacatacgccttcctcccgtcccccttgcaagtaacaccaagtacaggaatacttaacctnttccancgactacgtcttcgctcgcgttagggtcactcacctcgcccgattacgtgacacggtaaccgttgtcttccggngacgcggtcttcnccgtcttntcgttactatgtcncgactattcgactactttcgagtactacctcagtcatcgtccctacgacacgactaccctaccttaccaccgacggttcctaacgacgaacccgtcccgtaaccccctaacccgaaacccaacgaccgtaaacgtaacgtccgttacgccgttaccgccctacgtacgtccgttaaccggtgtaccgttagttttaccgggtttaccccgtttacccgttttaccggaacccttttccccggttcccacccttaccggttcgaaacggtacccgtttaagttaacccg

SEQ ID NO: 151701 - DNA, 178 bp, Homo sapiens
  misc_feature: GYAE6OF01AB6XK.24.50.E06.1.454.CMB.1.raw
  modified_base (177)..(178): a, c, t, g, unknown or other
  misc_feature (177)..(178): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccctcgtctctactgagcgggctggcaaggcgcatagnn

SEQ ID NO: 151702 - DNA, 177 bp, Homo sapiens
  misc_feature: GYAE6OF01DWDAZ.24.50.E06.1.454.CMB.1.raw
  modified_base (177)..(177): a, c, t, g, unknown or other
  misc_feature (177)..(177): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccctcgtctctactgagcgggctggcaaggcgcatagn

SEQ ID NO: 151703 - DNA, 178 bp, Homo sapiens
  misc_feature: GYAE6OF01ANUZ6.24.50.E06.1.454.CMB.1.raw
  modified_base (176)..(178): a, c, t, g, unknown or other
  misc_feature (176)..(178): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccaatagtagtctgagcgggctggcaaggcgcatagnnn

SEQ ID NO: 151704 - DNA, 177 bp, Homo sapiens
  misc_feature: GYAE6OF01BDFR0.24.50.E06.1.454.CMB.1.raw
  modified_base (177)..(177): a, c, t, g, unknown or other
  misc_feature (177)..(177): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagn

SEQ ID NO: 151705 - DNA, 177 bp, Homo sapiens; identical to SEQ ID NO: 151704
  misc_feature: GYAE6OF01DMYRZ.24.50.E06.1.454.CMB.1.raw
  modified_base (177)..(177): a, c, t, g, unknown or other
  misc_feature (177)..(177): n is a, c, g, or t

SEQ ID NO: 151706 - DNA, 178 bp, Homo sapiens; identical to SEQ ID NO: 151701
  misc_feature: GYAE6OF01ET882.24.50.E06.1.454.CMB.1.raw
  modified_base (177)..(178): a, c, t, g, unknown or other
  misc_feature (177)..(178): n is a, c, g, or t

SEQ ID NO: 151707 - DNA, 178 bp, Homo sapiens
  misc_feature: GYAE6OF01CSN28.24.50.E06.1.454.CMB.1.raw
  modified_base (177)..(178): a, c, t, g, unknown or other
  misc_feature (177)..(178): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagnn

SEQ ID NO: 151708 - DNA, 181 bp, Homo sapiens
  misc_feature: GYAE6OF01CLE4T.24.50.E06.1.454.CMB.1.raw
  modified_base (177)..(181): a, c, t, g, unknown or other
  misc_feature (177)..(181): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagnnnnn

SEQ ID NO: 151709 - DNA, 183 bp, Homo sapiens
  misc_feature: GYAE6OF01BK2Y8.24.50.E06.1.454.CMB.1.raw
  modified_base (177)..(183): a, c, t, g, unknown or other
  misc_feature (177)..(183): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagnnnnnnn

SEQ ID NO: 151710 - DNA, 179 bp, Homo sapiens
  misc_feature: GYAE6OF01D643X.24.50.E06.1.454.CMB.1.raw
  modified_base (178)..(179): a, c, t, g, unknown or other
  misc_feature (178)..(179): n is a, c, g, or t
tcagactactatgtcacgaccggtgctcgatttagatctactgacaacacacaagggcccatcggtcttccccctggcaccctcctccaagagcacctctggggcacagcggccctgggctgcctggtcaaggactacttccctcgtctctactgagcgggctggcaaggcgcatagnn

SEQ ID NO: 151711 - DNA, 178 bp, Homo sapiens; identical to SEQ ID NO: 151701
  misc_feature: GYAE6OF01DP4ZX.24.50.E06.1.454.CMB.1.raw
  modified_base (177)..(178): a, c, t, g, unknown or other
  misc_feature (177)..(178): n is a, c, g, or t

SEQ ID NO: 151712 - DNA, 181 bp, Homo sapiens; identical to SEQ ID NO: 151708
  misc_feature: GYAE6OF01AMGME.24.50.E06.1.454.CMB.1.raw
  modified_base (177)..(181): a, c, t, g, unknown or other
  misc_feature (177)..(181): n is a, c, g, or t

SEQ ID NO: 151713 - DNA, 181 bp, Homo sapiens; identical to SEQ ID NO: 151708
  misc_feature: GYAE6OF01EXU2P.24.50.E06.1.454.CMB.1.raw
  modified_base (177)..(181): a, c, t, g, unknown or other
  misc_feature (177)..(181): n is a, c, g, or t

SEQ ID NO: 151714 - DNA, 180 bp, Homo sapiens
  misc_feature: GYAE6OF01ATBM0.24.50.E06.1.454.CMB.1.raw
  modified_base (177)..(180): a, c, t, g, unknown or other
  misc_feature (177)..(180): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagnnnn

SEQ ID NO: 151715 - DNA, 191 bp, Homo sapiens
  misc_feature: GYAE6OF01BHJAD.24.50.E06.1.454.CMB.1.raw
  modified_base (178)..(191): a, c, t, g, unknown or other
  misc_feature (178)..(191): n is a, c, g, or t
tcagactactatgtcacgaccggtgctcgatttagatctactgacaacacacaagggcccatcggtcttccccctggcaccctcctccaagagcacctctggggcacagcggccctgggctgcctggtcaaggactacttccacatagtagtctgagcgggctggcaaggcgcatagnnnnnnnnnnnnnn

SEQ ID NO: 151716 - DNA, 191 bp, Homo sapiens
  misc_feature: GYAE6OF01BP6XP.24.50.E06.1.454.CMB.1.raw
  modified_base (182)..(191): a, c, t, g, unknown or other
  misc_feature (182)..(191): n is a, c, g, or t
tcagactactatgtcacgaccggtgctcgatttagatctactgacaacacacaagggcccatcggtcttccccctggcaccctcctccaagagcacctcgtgggggcacaggcggccctgggctgcctggtcaaggctacttccacatagtagtctgagcggggctgggcaaggcgcatagnnnnnnnnnn

SEQ ID NO: 151717 - DNA, 174 bp, Homo sapiens
  misc_feature: GYAE6OF02IQY67.24.50.E06.1.454.CMB.1.raw
  modified_base (173)..(174): a, c, t, g, unknown or other
  misc_feature (173)..(174): n is a, c, g, or t
tcagactactatgtcacgaccggtgctcgatttagatctactgacaacacacaaggccatcggtcttccctggcaccctcctccaagagcacctctgggcacagcggccctgggctgcctggtcaaggactacttccacatagtagtctgagcgggctggcaaggcgcatagnn

SEQ ID NO: 151718 - DNA, 177 bp, Homo sapiens; identical to SEQ ID NO: 151702
  misc_feature: GYAE6OF02GDF6C.24.50.E06.1.454.CMB.1.raw
  modified_base (177)..(177): a, c, t, g, unknown or other
  misc_feature (177)..(177): n is a, c, g, or t

SEQ ID NO: 151719 - DNA, 180 bp, Homo sapiens; identical to SEQ ID NO: 151714
  misc_feature: GYAE6OF02FVLXQ.24.50.E06.1.454.CMB.1.raw
  modified_base (177)..(180): a, c, t, g, unknown or other
  misc_feature (177)..(180): n is a, c, g, or t

SEQ ID NO: 151720 - DNA, 179 bp, Homo sapiens
  misc_feature: GYAE6OF02GIREQ.24.50.E06.1.454.CMB.1.raw
  modified_base (177)..(179): a, c, t, g, unknown or other
  misc_feature (177)..(179): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccctcgtctctactgagcgggctggcaaggcgcatagnnn

SEQ ID NO: 151721 - DNA, 179 bp, Homo sapiens
  misc_feature: GYAE6OF02FJ6OT.24.50.E06.1.454.CMB.1.raw
  modified_base (177)..(179): a, c, t, g, unknown or other
  misc_feature (177)..(179): n is a, c, g, or t
tcagactactatgtcacgaccggtgctcgatttagatctactgacaacacacaagggcccatcggtcttcccctggcaccctcctccaagagcacctctggggcacagcggccctgggctgcctggtcaaggactacttccacatagtagtctgagcgggctggcaaggcgcatagnnn

SEQ ID NO: 151722 - DNA, 180 bp, Homo sapiens
  misc_feature: GYAE6OF02GM0WF.24.50.E06.1.454.CMB.1.raw
  modified_base (178)..(180): a, c, t, g, unknown or other
  misc_feature (178)..(180): n is a, c, g, or t
tcagactactatgtcacgaccggtgctcgatttagatctactgacaacacacaagggcccatcggtcttcccctggcaccctcctccaagagcacctctgggggcacagcggccctgggctgcctggtcaaggactacttccacatagtagtctgagcgggctggcaaggcgcatagnnn

SEQ ID NO: 151723 - DNA, 181 bp, Homo sapiens
  misc_feature: GYAE6OF02HV6IA.24.50.E06.1.454.CMB.1.raw
  modified_base (178)..(181): a, c, t, g, unknown or other
  misc_feature (178)..(181): n is a, c, g, or t
tcagactactatgtcacgaccggtgctcgatttagatctactgacaacacacaagggcccatcggtcttcccctggcaccctcctccaagagcacctctgggggcacagcggccctgggctgcctggtcaaggactacttccacatagtagtctgagcgggctggcaaggcgcatagnnnn

SEQ ID NO: 151724 - DNA, 180 bp, Homo sapiens
  misc_feature: GYAE6OF02GXFSH.24.50.E06.1.454.CMB.1.raw
  modified_base (176)..(180): a, c, t, g, unknown or other
  misc_feature (176)..(180): n is a, c, g, or t
tcagactactatgtcacgaccggtgctcgatttagatctactgacaacacacaaggcccatcggtcttcccctggcaccctcctccaagagcacctctggggcacagcggccctgggctgcctggtcaaggactacttccctcgtctctactgagcgggctggcaaggcgcatagnnnnn

SEQ ID NO: 151725 - DNA, 513 bp, Homo sapiens
  misc_feature: GYAE6OF01C19DA.45.68.G02.1.454.CMB.1.raw
  modified_base (439)..(439): a, c, t, g, unknown or other
  misc_feature (439)..(439): n is a, c, g, or t
  modified_base (490)..(490): a, c, t, g, unknown or other
  misc_feature (490)..(490): n is a, c, g, or t
  modified_base (510)..(510): a, c, t, g, unknown or other
  misc_feature (510)..(510): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaactcaccatcctcctgccgggccagtcagagtatggtattagcttacactggtaccagcagaagccaggtcagtctccaatgctcctcatcgagtatgctgcccagtccatctctcggggtcccctcgagttcagtggcagtggatcgtgggacagatttcaccctcaccatcaatacgccctagggaacgctagaagatgctgcaacgtatactgtcatcaagagttagtaactttaccncactacgttccggacaaagggaccaaagggtgaaatacgaaacgaataggngactgacaccatctgtcttntac

SEQ ID NO: 151726 - DNA, 489 bp, Homo sapiens
  misc_feature: GYAE6OF01CW3AT.45.68.G02.1.454.CMB.1.raw
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
  modified_base (486)..(486): a, c, t, g, unknown or other
  misc_feature (486)..(486): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaactcaccatctcctgccgggccagtcagagtatggtattagcttacactggtaccagcagaagccaggtcagtctccaatgctcctcatcgagtatgctgcccagtccatctctgggtcccctcgagttcagtggcagtgatctgggacagatttcaccctcaccatcaatagcctggaanctgaagatgctgcaacgtattactgtcatcagagtagtaatttacctnacacgttcggccaaagggaccaaggtgaaatcgaaacgatgtggctgcaccatctgtcttntac

SEQ ID NO: 151727 - DNA, 585 bp, Homo sapiens
  misc_feature: GYAE6OF01DZSUH.45.68.G02.1.454.CMB.1.raw
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaactcaccatctcctgccgggccagtcagagtattggtattagcttacactggtaccagcagaagccaggtcagtctccaatgctcctcatcgagtatgctgcccagtccatctctcgggtcccctgacggttcaggtggcagtggatcgtgggacagtactttccacccctcaccatacaatacgccctaggaacgctagaagatgctgactaacgttattactgtacatcagtaagttagttaaacttttaccctacgtaaccgtaccggtttaccggacccgaaacggggaaccctaaagggttacggaaaacttaccgaaaaacggtaacgttggtacgggacctcggacctaaccctattccttacggttcctttcgtaacccg

SEQ ID NO: 151728 - DNA, 659 bp, Homo sapiens
  misc_feature: GYAE6OF01BKG1V.45.68.G02.1.454.CMB.1.raw
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccgaggggtgaaattgtgctgactcagtctccagtactttcagttctgtgactaccaaaggacgaaactcaccatcctcctgccggcagtcagagtattggtatagcttacacgtggtaccagcaagaagccaggtcagtctaccaatcgctcctcatcggagtatcgctcgcccacgtcctatcctcggtcggggtcccctggtacgttcgaggtcggactaggtggtactcgtacgggactagttacctttacccgaaccccttcaacctatacctaagttaccggaccgttaagggaacgtaccgtaggaaacgtagttcgacgttacgaacgttaaacgttatttacgtgttaacacgttacgtaagtaacgttaagtttaacctttacccgtacgtacccgttaacggttacccgggaccgaaacgggtaaccggtaaaggtaccggaaaacttaaccgaaacgttaagaggtccgacgtacaccgtaaccttacgtacttcggtccttcgtaacccg

SEQ ID NO: 151729 - DNA, 697 bp, Homo sapiens
  misc_feature: GYAE6OF01AZS7J.45.68.G02.1.454.CMB.1.raw
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaactcacatctcctgccgggccagtcagagtattggtattagcttacactggtaccagcagaacgccaggtcagtctccaatcgcctcctcatcgagtatgctcgacctagtccatcgtcgtcggggtcccctggtacggttcaggttcggactaggtggacgtcgtagggtacagtactttccacccctcaccgtatacaaactcggtaccgtagggtaacgtcgtaggtaaacgtagtcggtaccgtacggtaaccgttaaacggtttactttaccgtaggttacctaacgttaacgtaacgggttaacgtttaaaccggtttaaccttttaccctaaccgttaaccgttacccgggtttaaccgggaaccggtaaaacggggtaaccgtaaagggtaaacggtaaaaccgttaacccgaaaacggtacggttacggtacggtacccgtacggtaaccctaaccgttacttaccgttacgtttcccttacgttaccccg

SEQ ID NO: 151730 - DNA, 553 bp, Homo sapiens
  misc_feature: GYAE6OF01BSKIE.45.68.G02.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (433)..(433): a, c, t, g, unknown or other
  misc_feature (433)..(433): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtnaaattgtgctgactcagtctccagactttcagtctgtgactccaaaggnaaactcaccatctcctgccgggcagtcagagtattggtattagctttacactggtaccagcagaagccaggtcagtctccaatgctcctcatcgagtatgctgcccagtccatctcgtcgggtcccctgtacggttcaggtgcaggtggatcgtgggacagtactttccaccctcaaccatacaatacgccttaggaactcgtagaagatgcctagtactaacgttattactgtacatnaagtattaagttaactttaccctactaacgtaccgttcggaccgaaacgggacctaaggtagaaaacgtacgaaacgtatcggtcggactacgtaccactactcttcgttcttctacccg

SEQ ID NO: 151731 - DNA, 673 bp, Homo sapiens
  misc_feature: GYAE6OF01EYCR5.45.68.G02.1.454.CMB.1.raw
  modified_base (298)..(298): a, c, t, g, unknown or other
  misc_feature (298)..(298): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaactcacctatcctcctcggccgggccagtcagtagttagttggtattagtcttacactggtaccagcagaacgccaggtcagtctccaatcgctcctcntcgagtatcgctcgacccactccattccgtcggtccgggtcccctcggtaggttcgaggttcggacgtaggttggacgtcggtacgggtactaacgttacttcctacccctacgtacccacttacaacgttaccggtaccgtagggtaacgtaccgtaaggtaacgacgttacgccgtagtaccgttaaacgttaactttaccgttagttaccaacgttacgaagttaacgtttaacgttaaacctttacccgtaccgttaaccgtaaccggtttaccgggaaccggtaaccgggaacgtaaacgggtagtaaaaccgttacgaaaacgttacgtaggtcggactcgaccgtacctacgtcttcttctcgttacc

SEQ ID NO: 151732 - DNA, 645 bp, Homo sapiens
  misc_feature: GYAE6OF01E2HTJ.45.68.G02.1.454.CMB.1.raw
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
tcagacgcgatcgacacgaccggtgctcgatttagtcgatagtgaagggaaagggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaactcaccatctcctgccgggccagtcagagtattggtattagcttacnctggtaccagcagaagccaggtcagtctccaatcgctcctcatcgagtatcgctcgcccagtccatctcgtcgggtcccctgacggttcagtgcgagtggatcgtggactagtactttccgaccctccacctactactaactacgccgtaggaacgtcgtaggaaacgtagtgacgtcgactaacggttatacgttgtactactactaaggtagttaacgttaactttacctaacgtaccgttaaccggttaccggaaccggtaacgggtaaacccgtaaagggttaacgggaaaaaccgttaaaccgaaaaccggtaacggtttacgggtacggaccgttaaccggaccccgtaacccgtagtttacccgttacgtttccgttaacccgttacccccg

SEQ ID NO: 151733 - DNA, 565 bp, Homo sapiens
  misc_feature: GYAE6OF01EZI53.45.68.G02.1.454.CMB.1.raw
  modified_base (147)..(147): a, c, t, g, unknown or other
  misc_feature (147)..(147): n is a, c, g, or t
  modified_base (449)..(449): a, c, t, g, unknown or other
  misc_feature (449)..(449): n is a, c, g, or t
tcagacgcgatcgacacgaccggtgctcgatttagtcgatagtgaagggaaaggggatgagcaaaactgacaagtcaaggcaggaagatggttgccatcacaactcattgggtttctgctgctctgggttccagccctccaggggtnaaattgtgctgactcagtctccagactttcagtctgtgactccaaaggagaaactcaccatctcctgccggccagtcagtagtattggattagcttacactggtaccagcagaacgccaggtcagtctcaatcgctctcatcgatatgctcgacccagtccatctcgtacgggtcccctggtaggttccaggtgcaggtgatcgtggactagtctttcgaccctgaccatcaatcgaccgtgaagtctaagagactgctacgactacgtatactgcatacagtagttacgtaactttacccncgtaacgtacgttaccggaccctaagggacctaagggttacgaaaccgtagaaacccggtaatacggtcggacctaaggccctaaacctacttaccttacgttaccttcgttaccc

SEQ ID NO: 151734 - DNA, 760 bp, Homo sapiens
  misc_feature: GYAE6OF01BUXTI.45.68.G02.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
tcagacgcgatcgacacgaccggtgctcgatttagtcgatagtgaagggaaaggggatgagcaaaactgacaagtcaaggcaggaagatgttgccatcacaactcattggtttctgctgctctgggttcagcctccgagggtnaaattgngctagactcagtcctcagtactttcagtctgtgactaccgaaaggacaactcaccagtcctccgtggccggaccagtcagtattgttaggtattagccttacacgtaggtaccagcgaagtacgccgtagtcctaagtcctaccgaatcgccttaccgtgaacgtcggtagttacgtcgtaccgtccgaccctacgtacctacgttccgtccggtttcccgggtacccctcgggtaacggtttacgcggtcgggaccgttaggtcggaacttcggacggtaacgtacgttaacgttccctaacccgtacgtaaccgtaattaacctaacgtccggtaaccgtagggaacgtacgtaaggtaacgtacgttacgtaccgtagtaaccgttaacgttacgtttactagtactacgtacgtaagttaacgttaaacgtttaaccttacccgttaccgtaacgttacccgggtaaccgtacccggaaaaacggttaccgggttaaacggacgtaaaaaccgtttaaccggaaaacgttaccggttacggacggttacctaaccggcctaaaaccgttcgttaccgttcgttaaacccgttccgttaaccccggg

SEQ ID NO: 151735 - DNA, 498 bp, Homo sapiens
  misc_feature: GYAE6OF02HAHWR.45.68.G02.1.454.CMB.1.raw
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (497)..(497): a, c, t, g, unknown or other
  misc_feature (497)..(497): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaactcaccatctcctgccgggccagtcagagtattggtattagcttacactggtaccagcagaagccaggtcagtctccaatgctcctcatcgagtatgctgcccagtccatctctgggtcccctcgaggttcagtggcagtggatctgggacagatttcaccctnaccatcaatgcctaggaagctagaagatgctgacaacgtattacngtcatcagagtagtattaccnaacgcgttcggcaaagggaccaaggtacgaaatcgaaagactgtaggctaggcaccatctgtcttcnc

SEQ ID NO: 151736 - DNA, 495 bp, Homo sapiens
  misc_feature: GYAE6OF02FUKT5.45.68.G02.1.454.CMB.1.raw
  modified_base (194)..(194): a, c, t, g, unknown or other
  misc_feature (194)..(194): n is a, c, g, or t
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaactcaccatctcctgccgggccagtcagagtattggtattagcttacactggtaccagcagaagccaggtcagtctccaatgctcctcatcgagtatgctgcccagtccatctctggggtcccctgaggttcagtggcagtggatcgtgggacagtatttcaccctcaccatcaatagcctggaanctgaagatgctgcaacgtattactgtcatcagtagtagtaatttaccncactacgttcgaccaagggaccaaggtgaatcgaaacgactgtagctgcacatctgtcttctac

SEQ ID NO: 151737 - DNA, 657 bp, Homo sapiens
  misc_feature: GYAE6OF02G8EZZ.45.68.G02.1.454.CMB.1.raw
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaactcaccatctcctgccggccagtcagagtattggtattagcttacactggtaccagcagaacgccaggtcagtctccaatgctcctcatcgagtatgctcgcccagtccatctcgtcgggtcccctggtacggttcaggtgctaggtcgagtcgaggacagtactttccaccctcaccatacaagtcgccgtaggaacgtcgtaggaaagtatacgcgtacgtacgtaaacgtttacttaacgttcgtacacgttacgaaggttaacggttaaacgtttaaaccttttacccgtaaccgtaacccgttaaccgggtttaccgggaaacccgtaaaccgggggtaaccgtaaacgggttaaccggaaaagttaacccgaaaaacgggttaaccgtggtaaccgggaccttacggaccccgtaacctacgttaccggtactttaccgttaccttaaccccg

SEQ ID NO: 151738 - DNA, 872 bp, Homo sapiens
  misc_feature: GYAE6OF02IX97C.45.68.G02.1.454.CMB.1.raw
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctggttccagcctccgaggggtgaaattggtgctgactcagtctccagtactttnagtctgtgactaccgaaagganaaacctcacctagtcctcgtacggcccggaccngttccaaggtacgtacttaggttacttacgccttacacgttcggtaaccacggtcaacggtaacgcccgtaacggtctaacgtacctacccgaattcgcctacctctaaggttccgaaggttatcggtaccgttcgaccgtaggtaccctagttcccgttacggtccggggttccccctacggtccgggtttaacgtgggtacggtcggaaggttaggggacttttaacgggtcggggtaaactacggtttaacctttaccccgtaacccctaccgaacccgtaagttaccaaaaggttacccgacccggtaaacggggacgttaccgttaaacggaaacggttgtaaccgggtcccgtaccggttaaaccgttaaagttttaacccgtttacccgttaccgttaaaccgtaccgtttaaacgggaacgtttaaacggtttttaaccgttttaaacccgtttaacccgtaccgttaacccggttaaccggggtttaaacccgaacccggtaaaagggggttaccctaaaaggggtaacccgttaaataaaccccggtaaaccggttaacggttcggggtaaccgttaaccgtcgtacccgtaacctacggtttacctaggttcccctttaccgtacccgg

SEQ ID NO: 151739 - DNA, 564 bp, Homo sapiens
  misc_feature: GYAE6OF02HMETB.45.68.G02.1.454.CMB.1.raw
  modified_base (145)..(145): a, c, t, g, unknown or other
  misc_feature (145)..(145): n is a, c, g, or t
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtnaaattgtgctgactcagtctccagtctttcagtctgtgactacaaagganaaactcaccatcctcncgccggccagtcagngttattggtaattagccttacacgtcggtaccagcaagaacgaccgaggtcagtcctaccaatcgcctcctanactcgatacgtgctcgcccatccatcgtcgtcgggtcccctggtacgtcagtcggngagtgagtgacggactagtacttccacctcactactacatcgtccgtaggacngtaagaagatgacgtagactaacgttactacgtctacntacagtattaacgttacttacgtaccacgttaccgtacggaccgaaagggtaccgtaaggtacgtaacgtacgaaacgggtactaggtacgtcacgctacctattcgtctactctacc

SEQ ID NO: 151740 - DNA, 648 bp, Homo sapiens
  misc_feature: GYAE6OF02GRO5K.45.68.G02.1.454.CMB.1.raw
tcagacgcgatcgacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaactcaccatctcctgccggccagtcagagtattggattagcttacatggtaccagcagagccaggtcagtctccaatgcctcctcatcgagtatcgctcgcccagtccatccgttcgtccggggttcccctcggtacggttcgaggttcggcgtaggttcgggacttcggtacggggactacggtactttccacccttacaccgtactaccaacgtacgtaccgtaagggaacgtactaacgggaaagtaacgttcggaccgtacgtaaccgttaaacggtttactttaccgttagtacgtacttacgtaaggttaacgttaaacgtttaacgtttaacctaccgtacgttaccgttacgggaaccgtaaacgggaaccgtaagggtacgaaactaccggaaagtaccgtggtcggtactacgactactagttctacgttcttactacccg

SEQ ID NO: 151741 - DNA, 763 bp, Homo sapiens
  misc_feature: GYAE6OF02JCY7A.45.68.G02.1.454.CMB.1.raw
  modified_base (150)..(150): a, c, t, g, unknown or other
  misc_feature (150)..(150): n is a, c, g, or t
  modified_base (181)..(181): a, c, t, g, unknown or other
  misc_feature (181)..(181): n is a, c, g, or t
  modified_base (513)..(513): a, c, t, g, unknown or other
  misc_feature (513)..(513): n is a, c, g, or t
tcagacgcgatcgacacgaccggtgctcgatttagtcgatagtgaagggaaaggggatgagcaaaactgacaagtcaaggcaggaagatgttgccatcacaactcattgggtttctgctgctctgggtccagcctcgagggtagaattgngctgactcacgtctcctagtactttcagtcngtcgactacaaaggacaaactcacctactctacctcggccgggacctagtacaagtacgttagttaggtaattacgtaccttaacgacgttagggtaacctaaggacgtaagaacgaccgtaagtccgtaacgtccgtacctaatcgaccttaccgtacagtaccgtagtaactcgacctcgccagtcctatccggtcgtccgggtcccctggtacgttcgtacggtgtaccgtagtcggtagtcggtaacggactagttaccttcccgaacctacctacctaacgttacgaagtaccgtcggtacggtaaacgtcggtaaagtaagtacgngtaccgtagtaaccgttaacgttaacgttcgtaaccgttctaacgtaaccgtagttaaggttaaacctttacccgtttaacgttacccgtaaacccggtacccggttaaccggaaacccgggtaaaccgggttaaacggtaacccggtaagttaaacccgtaacgtaaaccggttaacccggtagttaaccgggaacttccggtaaccctaaccgtgtttaaccgttacggttaccttaaccggttcccc

SEQ ID NO: 151742 - DNA, 577 bp, Homo sapiens
  misc_feature: GYAE6OF01BQ1EN.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcactctgtcggagacagagtccaccatcacttcggccgggccagtcagagtattgagtaggttggttggccgtggtatcagcaacgaaaccgagggaaccgacccctaacctcctacactctctactgcactcctactttgactaaaggtcgggtacccatcgtaaggttcacggcggacgaggtggatcgtgggacagtatttcacttctactactatcagacagtccctgcagcctagaacgttagttttacggaactttactacttgtacaacgtagtaacgttacccggtacccgtacttacgtttacggaccgtacgggaacctaacgtcgactacgtaccgaaacgtataggtcgtactcgacctactacttctcgttctcgtacc

SEQ ID NO: 151743 - DNA, 572 bp, Homo sapiens
  misc_feature: GYAE6OF01B52RK.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctgtttcccaggtgccagatgtgacatccagatgacccagtcgccatcctcactgtctgcatctgtaggagacacagtcaccatcacttgccgggcgagtcaggacattagcaattattagcctggtatcagcagaaaccagggaaagttctaagctcctgatctatgtacatcctactttgctaagttcgggtccatctcgttcagtgcagtgatcgtggactagtatttcactctcacctatcagtcagcctgcagccttagaacgtattcgttagactaaaccgtttatttacgtagttaacaaaaattactaaactacgtaccgaccccgtactaccgtaccgtttacggggaccgggtaacgggacccgtaaagggtcgggaacgtaaacgttaacccgaaaacggtaacgttacggtacgggaccttggaccctaacccg

SEQ ID NO: 151744 - DNA, 531 bp, Homo sapiens
  misc_feature: GYAE6OF01B3MYW.47.80.H03.1.454.CMB.1.raw
  modified_base (523)..(523): a, c, t, g, unknown or other
  misc_feature (523)..(523): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaacggcccctaagcgcctgatctatggtgcatacactttgacaaagtgggtccatcaaggttcagcggacaggtaggtcgtgggacagagttcactctcactatcagcggcctgcagcctagaagtattctgactaactttattactgtctcctagtatgtatcgtccttacccgtcggtactttccggaccgtaagggaaccgaaggtacgaaagtacaaaacggtaacgtggtacggtctagaccacctntcgttacg

SEQ ID NO: 151745 - DNA, 517 bp, Homo sapiens
  misc_feature: GYAE6OF01BD64K.47.80.H03.1.454.CMB.1.raw
  modified_base (392)..(392): a, c, t, g, unknown or other
  misc_feature (392)..(392): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtccatcaaggtcagcgcagtagtcgtgggacagagttcactctcactatcagcggctgcagcctgaagattcngacaacttattactgtctcagttatgattgtccttaccctcggtacctttcggaccgtaaacgggtaaccgaagggtaggaaactacgaaacggaacgtgtacggctacgacacctatcgttacg

SEQ ID NO: 151746 - DNA, 513 bp, Homo sapiens
  misc_feature: GYAE6OF01BH0RF.47.80.H03.1.454.CMB.1.raw
  modified_base (374)..(374): a, c, t, g, unknown or other
  misc_feature (374)..(374): n is a, c, g, or t
  modified_base (492)..(492): a, c, t, g, unknown or other
  misc_feature (492)..(492): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaaagcccctgaactcttaatctataaggctctattttagaaactggggtccatcaaggttcagcggcagtggatctgggacagagttcactctcacatcaacnccctgcagcctgatgtattttgcgtacttattactgacctaaaagtataatagtcgaccttccgtcggtttcgcccgttaggaccaagtggatgtacaaacgactggtgctcgcaccntctcgtattcattccttcccg

SEQ ID NO: 151747 - DNA, 560 bp, Homo sapiens
  misc_feature: GYAE6OF01C5HDV.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggtggctggtatcacagaaccaggaaacgcccctaactcctgatctatgctgcatccagtttgcataggtcgggtccatctaggttcagtggcagtggatcgtgggacaggtatttcacttctacaccatcaagtcagttctgtacaacctgaagtatttcgactaactttactactagtacaactagtaacggtttaccgtacccgttactacgttttacggccgtaacggggtaacccaaacgtcgggaactacgtaaccgaaaaccgtaacgttggtacggacttacggacctaaccattcctgttcccttaccg

SEQ ID NO: 151748 - DNA, 843 bp, Homo sapiens
  misc_feature: GYAE6OF01EZUP1.47.80.H03.1.454.CMB.1.raw
  modified_base (102)..(102): a, c, t, g, unknown or other
  misc_feature (102)..(102): n is a, c, g, or t
tcagagctcacgtacacgaccggtgctcgatttagctgtgcgtcgaagggaaagggggagtcagacccagtcaggacacagcatggacatgagggtccccgntcagctccgtgggctcctgctgctcgtggcctcccgaggtcgaccaaatggtgacactaccagatcgaccctagtccttcccttcccaccctgtctgctatcgtggtcggagacagacgtccaccatcctacgttcggcccgggacctagtcgaggtagttattgagttagggtgggttcggtccgtaggtatcgagacgaacgaaaccgaagggaaccgccccgtacgtaacttacttaactactaagtaacggtccgttactttaagttttaacggtaacggttccggggttaccctaagttacgtaaacgggtttaccgaacgggtaccggacggtagggttacgggtacgttacggtacggggtaactaggttaacgtttaccctaccgtttcctacccaaccctaactaacccaacccgtaccccgtacggaccgtacgtacccgtagtacgttagttacgttttaccggaccgttaaccttttaacgttaaccgtacgtaaacccgttaaaagtttaactaaacgttacggtaccgttaaccccgtttcccggtttacccggggttttaccccgggtacccggtttaacggggtaaacccgttaaaggggttacggtaacgttaccggtaaaccgtaaaaccggttaacggtttcgggtacgggtaccgttaccggaccctaaacgtacctttacgttacgtttaccctttcctacgtttcccccgttacccccg

SEQ ID NO: 151749 - DNA, 664 bp, Homo sapiens
  misc_feature: GYAE6OF01CONSD.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaagcccctagaactcttaatctataaggctctatttagaacgtcgggtccatcaaggttcagcggcagtggatcgtgggacagtagtcactctacaccataccaacaccctagaccagtccctagacttgttattttcgaccgtaactttaacttactacgtaaccctaaaagttaacttaaagttacggtaccgtaacccgttccccgtttaccggggttttcccgggtaccccgttacggggtaaacccgtaaagggttacgggtaacgttacggtaaacccgtaaaaccggtaaccgtttacgggtacgggtacccttacggacccgtaaacccgttacgttaccgttacgtttacccgtttaccctacgtttccccgtttaccccccgg

SEQ ID NO: 151750 - DNA, 504 bp, Homo sapiens
  misc_feature: GYAE6OF01ATQLD.47.80.H03.1.454.CMB.1.raw
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggcagtcagagtatgataggtggttggcctggtatcagcagaaacagggaacgcccctagaactcttaatctatagcgtatatttagaactgggtccatcaagttcagcggcagtggatcgtgggacagagttcactctcacactaccaaccaccctgcacgcctgatgtatttgcgtactttattactagaacctaaagtataatagtctaccttccgtcggttccgccgtaggacaagtgatgtacaacgagtgtgctncactntctntcttcactcctcccg

SEQ ID NO: 151751 - DNA, 622 bp, Homo sapiens
  misc_feature: GYAE6OF01APDJH.47.80.H03.1.454.CMB.1.raw
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaaagcccctgaactcttaatctataaggcgttactattttagaactggggtccatcaaggttcagcggnagtggatcgtgggacaggagttcacttcgtcaccataccaacnccctgacacgccctagactgtattttcgacgtactttattactcgaacctaaaagttataattaagtcgtaacccttcccgttaccggggtttccggaccccgttaggggtaaccctaaagggttcggtaacgttacgttaaccgaaaaccggtaacggttcggtacgggccttacggaccctaaacccgtacgttaccgttcgttacccgtttctaaccgtttcccgtttacccccgg

SEQ ID NO: 151752 - DNA, 700 bp, Homo sapiens
  misc_feature: GYAE6OF01DVEP1.47.80.H03.1.454.CMB.1.raw
  modified_base (199)..(199): a, c, t, g, unknown or other
  misc_feature (199)..(199): n is a, c, g, or t
tcagagctcacgtacacgaccggtgctcgatttagctgtgcgtcgaaagggaaagggggagtcagacccagtcaggacacagcatggacatgagggtccccgctcagctccgtggggctcctgctgctctggctcccaggtgccaaatgtgacatccagatgacccagtctccttccaccctgtctgcatctgtcgganacagatcacatcacttgccggcagtcagagtatgataggtgtgctggtatcagcaagaaaccgaggaaacgcccctagaacttacttaatactaagtaacggtcgttacttaattttaagaaacgttcgggtacccagtacaaggttacagcggcaggtaggagtacgtggaacaggtacgtcctacgtctaccaacctaactaccaaacctacccgtcgaccgtacgtacccgtagtacttgttaattttacggtccgtttaaactttactttaaccgtacgtaacctaaaaaggtttaacttaaagtacgttaaccgttacccgtttacccggtttaccggggttttacccggacccggttaggggtaaaccctaagggttacggtaaacgtttacggtaaaacccgtaaacggtacgttacgggtaacggtcgttacccgacctaaaccgttactttaccgtaaccgtttctttaaccctgtttaccccgttaccccg

SEQ ID NO: 151753 - DNA, 704 bp, Homo sapiens
  misc_feature: GYAE6OF01AFX3Q.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatcgacccagtcctccttccaccctgtctgcatctgtcggagacagactcacatcacgtcgccggcagtcagtagtatgagtaggtggtcggccgtgtatcagcaagaaccgaggaacgccctagaacttacttaactctaagtaacggtcgttacttaagttttaacggaacgttcggggtaccctaagttaccgtaaggttccgaggtccggacgtaaggttagacgtcggtacgggaactaggtacgttacaccttccgtaccaaccgtataacctaaccctacccgtacgcctaacgtaccgttagtaacgttcgttaacgtttttcgaccgttaaactttaacgttaccgtaacgtaaacctaaaaagttacgtaaacgtttacggttaacccgtacccgtttcccggtttacccgggtttacccggacccggttaacggtaacctaagggttcgaagttacgtaaaccgaaacggtacgttggaccggtacgtacgaccctaacgtcgtaccttcttaccgttctaccgttcccttacccg

SEQ ID NO: 151754 - DNA, 590 bp, Homo sapiens
  misc_feature: GYAE6OF01D8AB0.47.80.H03.1.454.CMB.1.raw
  modified_base (275)..(275): a, c, t, g, unknown or other
  misc_feature (275)..(275): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (578)..(578): a, c, t, g, unknown or other
  misc_feature (578)..(578): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttcgccggccagtcagagtatgataggtggttggcctggtatcagcaagaaaccgaggaacnccctagaactacttaatactaagtaaggctatatttagaacgtgggtaccatacgaagtcagcggactaggtgatcgtaggacagtagtcacttcacactactacaaccncccgtgacacnccgtagtacgttgtatttcgacttactttaatacgtacgtaactaaaagttataaagttagtcgtaacccgttccgttacgggtttccggacccgttaggggaacctaaaggtggtaattacgtaaccgtaaaacgtacgtggtacggactacgcctaactacgttctacttaccttacctnttcccgtacccg

SEQ ID NO: 151755 - DNA, 580 bp, Homo sapiens
  misc_feature: GYAE6OF01ERV53.47.80.H03.1.454.CMB.1.raw
  modified_base (275)..(275): a, c, t, g, unknown or other
  misc_feature (275)..(275): n is a, c, g, or t
  modified_base (572)..(572): a, c, t, g, unknown or other
  misc_feature (572)..(572): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgtcgggcgagtcagggtattagcaacgtggtagcctggtatcaacagaaaccagggaacncccctaacctcctcatctctactgcactcctactttgactaaaggtcggggtacccatacgtaaggttcaggcggcaggtggatcgtagggactagtacttcactctacactatcagcacgctgacacgacctggtaaagttattttaggtaactttattattacgtactaacgtagggttaactcggtttacccgcttaccgtaccggttcgggacgggaacgggtaccgaagggtcggaagtagtaaggaaaagtcgtaggtcggacgtcgaccactacgttactagttccttcncgttcccg

SEQ ID NO: 151756 - DNA, 562 bp, Homo sapiens
  misc_feature: GYAE6OF01A80Y6.47.80.H03.1.454.CMB.1.raw
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (547)..(547): a, c, t, g, unknown or other
  misc_feature (547)..(547): n is a, c, g, or t
tcagagctcacgtacacgaccggtgctcgatttagctgtgcgtcgaagggaaagggggagtcagtcccaaccaggacacagcctggacatgagggtccctgctcagctcctggggctcctgctgctctggttcccaggtgccaggtgtgacatccagatgacccagtctccatcctccctgtctgcatctgtaggagacagagtcaccatcacttgccgggcgagtcgagggcgttgcaaatgctttggcctggtttcagcagacaccgagggaacggcccctaagcgcctgatctatggtgcatacactttgacaagtcggggtcccatcaaggttcagcggcagtaggtctgggacagagttcactctcactatcagccgcctgcagcctgaagnttcgncctaactttattactgtacctccagttactgtatcgtaccttacccgttccggtactttccgggaccgtaaacgggtaccctaaagggttacggaaacttacccgaaaacggtaaccttggtacggtaccgtcgaccgaaccctnttccgtgtttacccg

SEQ ID NO: 151757 - DNA, 753 bp, Homo sapiens
  misc_feature: GYAE6OF01AP0YT.47.80.H03.1.454.CMB.1.raw
  modified_base (698)..(698): a, c, t, g, unknown or other
  misc_feature (698)..(698): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctgtggctccgaggtcgccaaatgtcgactatccagatcgaccctagtccttcccttacccacccttgtctgctagttctagtcggaagaccagtacgtccaccatctaccgttcggcccggtactagtcagtacgtatagtagttagggtggttcgtaccgtaggtactacgacgacgaacgaaaccggaacgggaacctccccgtaataaccttacttaactacgtaacgttacggtccgtttaacgttttaagtttaacggtaacgttccggggttaaccctacgttacggtaacgggttccgaacggtacggtacgtaaggtacggtacgtcgggtaacggaacgtacggtttacgtacctaccgttaccgtaccctaaacctacttaaccccgtaaccgtccccgttagaccgtacgttaccgtaggtaactttgggtttaactttcggtaccttaacgtttactaacgtacgtaaattaaacgtattaagttcgtacctaccgttcggttaccggttaccgacgtcgggtaactacgtcgtatcgtaaaccgtgttaaggtcgggtanaacgtccgaacttacgttacgtgtttactcccgtttaacgtccccttccgtaccc

SEQ ID NO: 151758 - DNA, 717 bp, Homo sapiens
  misc_feature: GYAE6OF01BC5N6.47.80.H03.1.454.CMB.1.raw
  modified_base (101)..(101): a, c, t, g, unknown or other
  misc_feature (101)..(101): n is a, c, g, or t
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
  modified_base (470)..(470): a, c, t, g, unknown or other
  misc_feature (470)..(470): n is a, c, g, or t
  modified_base (663)..(663): a, c, t, g, unknown or other
  misc_feature (663)..(663): n is a, c, g, or t
tcagagctcacgtacacgaccggtgctcgatttagctgtgcgtcgaagggaaagggggagtcagacccagtcaggacacagcatggacatgaggtccccgntcagctctgggctcctgctgctctggctcccaggtgccaaatgtgacatccagatcgacccagtctccttccaccctgtcngcatcgtgtcggagaccngacgtccaccatccacgttcgccggaccagtcagtagttactgagtagggttggttcgccgttaggtactcgacgaccgaaggaaaacccgaggggtaaaccncccccttaggtaaacctttcttaacgtagtaaccgtaggtacgttactttaacgttttaagtaacgttcgggtaccctataccgttaaggtctacgcggacagggtccgagtaccgtagggactacgtagttccgtactccgtaaccgtacctactacccgtaaccncccgtactaccgaacgtcccgtagtagttacgtagtttacgcgtttaactttacgtactaccggtaactaaatttacgtaagttacgtccgttaacccttcccggttccggtttacccggacccggttacggaaaccgttaacggttaagtcgtaaccgtaaccgaaaccgtttacgacggttacggttaccnccgtactaccttacgttccttacgttacctttacttcccttcccggttaccccc

SEQ ID NO: 151759 - DNA, 760 bp, Homo sapiens
  misc_feature: GYAE6OF01A95DO.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggcctccaggtgccaaatgtgacatccagatcgacccagtcctccttcccaccctgtctgcatctgtcggagacagagtcaccatcacgttgccgggcagtcagagtattgacgtaggttggttcgcctggtatcgagacaacgaaacgacgggaacgcccctagaaccttacttaacttctaagtaacggtccgttacttagttttaagaacgttccggggtacccagttacgtaagggttccggacggcgtaggtcggtacgtcggtagggacgtacgtacgttaccaccgttacctacccgtaaccactaacccaaacccgtacccgtacgttacccacgtccccttaggtacgtttacggttacgttttaccggaacgtttacccgttttaatttacccgaaggtaaacccgttaaaagttaaactttaacgtaacggttaccgtaacccggtttccccggtttacccgggtttcccggtaccccggttaacgggtaaacccgtaagggtttacggtaacggttacgtaaacgtaaccggtaacgtttggaccggtcttacggcccttaacgttacccttacgtttcccgtttactttaacccctcgtttcccccttcccggtacccg

SEQ ID NO: 151760 - DNA, 714 bp, Homo sapiens
  misc_feature: GYAE6OF01A122P.47.80.H03.1.454.CMB.1.raw
  modified_base (176)..(176): a, c, t, g, unknown or other
  misc_feature (176)..(176): n is a, c, g, or t
  modified_base (492)..(492): a, c, t, g, unknown or other
  misc_feature (492)..(492): n is a, c, g, or t
tcagagctcacgtacacgaccggtgctcgatttagctgtgcgtcgaagggaaagggggagtcagacccagtcaggacacagcatggacatggacgggtccccgctcagcctccgtggggcctcctgctgctctggctcccagataccagatgtgacatccagatcgaccctagtcnccactccctcctgtctgcatctaggtaggacgacacgagtccaccatcacgttcggccgggagacgtcgaacggactacttagactaacttttagttccggccttaggtatacgacggaccaaacggaaaccggaaggggtaaccttaccgaagtccctccgagtaccttcgtacgttagttacccaacgttcctcgtttagaccgttaacggttcccggtaccagttcccgttcgggtactacggtggacctaggtgacgttaccgaggtacgtagttactccgtaccgtacttcacctacgtcaaccggtaccnccgtacgttaccaccgtacggtaccctagtaaacgttgttaccgtacgtaacccttaattaacgtttacggtaaactaacgttaaaacgttactaaccggttcgaccccgtccgtccgttaccgtacgggttacccggggacggaacgggtacccgtaagggtacgtaacggtaaaccaaccgggtttaacaacggtccggtagaccgtggtaccccgtaag

SEQ ID NO: 151761 - DNA, 796 bp, Homo sapiens
  misc_feature: GYAE6OF01AD0TO.47.80.H03.1.454.CMB.1.raw
  modified_base (105)..(105): a, c, t, g, unknown or other
  misc_feature (105)..(105): n is a, c, g, or t
  modified_base (227)..(227): a, c, t, g, unknown or other
  misc_feature (227)..(227): n is a, c, g, or t
tcagagctcacgtacacgaccggtgctcgatttagctgtgcgtcggaagggaaagggggagtcagacccagtcaggacacagcatggacatggacgggtccccgntcagctcgtggggctcctgctgctctggcctcccgaggtcgaccaaatgtgacatccagatcgaccagtcctccttccacctgtctgctattcgtggtacggatacgagtacgtaccaactntctacgttcggcccggtactaggttccgaaggtacgttagttaggaacggttacgggttacgggttcggtaccgttacggtacgtacgaacggtaaccgaaacgggaaaacccggtaacgggaacccgtcccctaaggtaacctttacgttaactacgtaacgttaacggtcgtttaacttaacgtttaaacggtaccgttaccgggccttaacggtacgttaacggtcgtacgggtcgacggtacggtcgtacgtcgggtacggacgtagttacctctaaccgtctaccgtacctacgtaaccacctaccggacgacgtacgtcggttactacgttaggtttaccgtttaccgacgttttaacctttaacgttaaccggtacgtaaacgttaaacgttacttaaacgttccgttaacccgttacccggtttaccgggtttaccggttaccccgggtacgtaccgggtaaggtaaccggtgtacctacgggtaaaccaacgggttcgtacggtccggaacttccaccgtattccgttgttaccccgtattcccggtactcccgttaccg

SEQ ID NO: 151762 - DNA, 551 bp, Homo sapiens
  misc_feature: GYAE6OF02HVXH7.47.80.H03.1.454.CMB.1.raw
  modified_base (269)..(269): a, c, t, g, unknown or other
  misc_feature (269)..(269): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctccccaggtgccaaatgtgacatccagatgacccagtctccttccaccctgtctgcatctgtcggagacagagtcaccatcacttgccgggccagtcagagtattgataggtggttggcctggtatcagcagaaaccngggaaagcccctagaactcttaatctataaggcgtctatttagaaactggggtccatcaaggttcagcggcagtggatcgtgggacagtagttcactctcacctatcaacaccctgccagcctgatgacttttgcgtaacttattactgacctaaaagtataaatagttctaccttccgttcggtttccggcccgttagggaacctaaaggtacggtatagtacgaacgtaacgtcgtaggctacggcaaccgtattctgttacctttcacttcctaccccg

SEQ ID NO: 151763 - DNA, 508 bp, Homo sapiens
  misc_feature: GYAE6OF02H79XR.47.80.H03.1.454.CMB.1.raw
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaaagcccctgaactcttaatctataaggcgtctattttagaaactggggtcccatcaaggttcagcggcagtggatctgggacagagttcactctcaccatcaacnccctgcagcctgatgattttgcgtacttattactgaccaaaagtntaatagtgaccccttntacggtttcgcccttgggaccaaagtgatgtacaacgatgtggctgcacatctgtcttacactcttcccg

SEQ ID NO: 151764 - DNA, 518 bp, Homo sapiens
  misc_feature: GYAE6OF02HTD8K.47.80.H03.1.454.CMB.1.raw
  modified_base (422)..(422): a, c, t, g, unknown or other
  misc_feature (422)..(422): n is a, c, g, or t
  modified_base (491)..(491): a, c, t, g, unknown or other
  misc_feature (491)..(491): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaagccctagaactacttaatctataagcgtactattttagaactgggtccatcaaggtcagcgcagtggatctgggacagtagtcactctcacatacaacaccctgcacgcctgactgtattttcgctacttattactagacctaaaagtntaaatagtcaaccttccgtcggtttccgccttaggaccaaagtggactgtacaaacgtacgtgtacggntacgacacatctgtctactatcctccc

SEQ ID NO: 151765 - DNA, 571 bp, Homo sapiens
  misc_feature: GYAE6OF02H17M6.47.80.H03.1.454.CMB.1.raw
tcagagctcacgtacacgaccggtgctcgatttagctgtgcgtcgaaggggaaagggggagtcagacccagtcaggacacagcatggacatgagggtccccgctcagctcctggggctccgctgctctggctccaggtgccaaatgtgacatccagatgacccagtctccttcaccctgtctgcatctgtcggagacagagtcaccatcacttgccgggcagtcagagtattgataggtggttggccttggtatcagcagaaaccagggaaagcccctagaactcttaatctataggcgtctatttagaaactgggtccatcaaggttcaggcgcagtgatctgggacagagtcactctcaccatacaacaccctgcacgcctagatgtatttgacgtacttattactacgtacctaaaagttataaactagttacgtaacccttccgttacgggtttacccggccctaggggaaccctaaaggttcggtaacttacggtaacctaaacgtaacgtggtacggtctacgcaaccgattctacgttaccttactacttcccgttccgtaccg

SEQ ID NO: 151766 - DNA, 510 bp, Homo sapiens
  misc_feature: GYAE6OF02JG4YA.47.80.H03.1.454.CMB.1.raw
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagggcttgcaatgctttggcctggtttcagcagacaccagggagccctaagcgcctgatctatggtncatacactttgctaaaggtgggtcccatcaaggttcaggcggcagtaggtctgggacagacgttcactctcactatcagccggctgcagcctagaactnttctgactaacttattactcgtactaccgtagtatgacttgtacctttaccgtcggtacttcggaccaggaccaagggtgaaactacgaaacgtacgtggtcgctgacactntntcg

SEQ ID NO: 151767 - DNA, 710 bp, Homo sapiens
  misc_feature: GYAE6OF02F4E9U.47.80.H03.1.454.CMB.1.raw
  modified_base (322)..(322): a, c, t, g, unknown or other
  misc_feature (322)..(322): n is a, c, g, or t
tcagagctcacgtacacgaccggtgctcgatttagctgtgcgtcgaaggggaaagggggagtcagacccagtcaggacacagcatggacatggacgggtccccgctcagctccgtggggctcctgctgctctggctcccaggtgccaaatgtgacatccagatgacccagtcctccttccaccctgtctgcatctggtcggagacagagtcacatcacgttggccgggcgagtcgagggtcgttgacctaaatgtcgtttggccttggtttcagtcaagacaccgagggaacggcccctaagcgtcctgactctagtggtcncaatacgtacgtttcgactaaacggttcggggtccctagtcggagggttcaggcggctaggtacgggtcgtaggggaactaggtacgttcaacgttcctacgtaaccttagtaccgaacggccggtccgtacgacgtaaccggtccgttaaggaactacgtttacgtaggtacccttaaacctttacgtttaccgtcggttcccttaccggtagtttacgtacgttacgtacgtttacccgttaacccggttcgggtttaacccgttccggggaaacccgtaacggggtaaccgtaaacggggttaaccggtaaacgtaacccggtaaaaccgtaacggttcggtaccggttacgtcggtaacccctaccgttacttccggttacccg

SEQ ID NO: 151768 - DNA, 660 bp, Homo sapiens
  misc_feature: GYAE6OF02IXAJ7.47.80.H03.1.454.CMB.1.raw
  modified_base (197)..(197): a, c, t, g, unknown or other
  misc_feature (197)..(197): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacacagtcaccatcacttggccgggcgagtcaggactagttagctaattatttagcctggtatcagacaagaaaccgaagggaaacgttacctaagcctaccgtagtacttctaattcgttaacacttacctactttcgacgtaacgttccggggtaccctagtccgttacggttcaaggtcggacgtaggttggacgttcggtacgggaactaggtacttttaccaccgttcctaccaaccctagtaccaacgtcacggtcctacggcctacgacccgtaggtaacgtacgttacggttactaccttaaacttttacgttacctcgttacctacgtagttagtcgtattccgttaccttacccgttcgttacccgtttcggacccggaaacgggtaccgtaaggtaacgtaaacgtaacgaaaccgtacgttaggcggtacgaccgacctaccgtagttccg

SEQ ID NO: 151769 - DNA, 491 bp, Homo sapiens
  misc_feature: GYAE6OF02FUEWI.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccatcctccctgtctgcatctgtaggagacagagtcaccatccacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttacttcaccatcagcagcctgcagcctagaagatattgacaacatattactgtacaacagtatcataactctacccactttcgccctggaccaagtgaatatcaaacgactgtcggctgcaccatctcg

SEQ ID NO: 151770 - DNA, 751 bp, Homo sapiens
  misc_feature: GYAE6OF02FG58M.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagactgacccagtcctccttccaccctgtctgcatctgtaggagacagacgtccaccatcctacgttcggccgggcgaggttcgaggggtcctttgacctaaagttcgtccttttcgggccgttacgggtttacagtaccacggaccgaaccggacggggaaccggcccctaaggccgacctagacttctagtggtcgactaactacctacgtttacgacgtaaacgggttcgggtaccctagtacgtaaggttcgaacggccggtacgtaggtacggttccgtaggggaactacggtacgtttcccaacctcgtacctaacgtttacgacccgtaacgggcccgggtacccttcggaccgtacgtacccgtaggtaaacgttctttacgtacgttaaaccttaacgtttacgtttaccgtacggttaccttaccgaagtttacgtagtaaccgttccgttacccgttaacccgttcgggtaccgtttacccgggaaccgtaacgggtaccgtaacgggttaaacgtaaacgtaacccgtaaaccggtcgttagggtccgtaccgtaccgaccgttaccgtactttccgttaaccg

SEQ ID NO: 151771 - DNA, 558 bp, Homo sapiens
  misc_feature: GYAE6OF02GBTD7.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcagagtattgataggtggttggcctggtatcagcagaaaccagggaacgcccctgaactcttaatctataaggcgtctattttagaaactggggtcccatacaaggttcagcggcagtgatcgtgggacagagttcactctcaccactacaaccaccctgacagcctgatgtatttcgacgtactttaattactgaacctaaaagttataatagtacgtacccttccgttccgggtttccggtcccgttacgggaacctaaaggtgtagttcgtacaaacgtacgttgtaggcctagaccacgtcttctacgttcttactcttccttccccg

SEQ ID NO: 151772 - DNA, 616 bp, Homo sapiens
  misc_feature: GYAE6OF02HM05O.47.80.H03.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtcgganacagagtcaccatcacttgccggccagtcagagtattgagtaggtggttggcctggtatcgagcaagaaaccgagggaacncccctagaactcttaatctagtaacggtctacttatttaagaacgtcgggtacctagtcgtaagggttcggcggacgtagtcggattcggtgggtaactaggtacgttacaccttctaccaacctactacccaaccacccgtagccacgtcctagtacgttgttactttcgacttacttacttactacgaacttaaaagtactaagtacgtacgtacccttccggttacggtttccggacccgttagggaaccctaaagggtcgaagttacgacaaacgtagttcggtgacctcggacctacctagttcttacgtaccttctcttcccgtccctacg

SEQ ID NO: 151773 - DNA, 864 bp, Homo sapiens
  misc_feature: GYAE6OF02GGQ0N.47.80.H03.1.454.CMB.1.raw
  modified_base (138)..(138): a, c, t, g, unknown or other
  misc_feature (138)..(138): n is a, c, g, or t
  modified_base (166)..(166): a, c, t, g, unknown or other
  misc_feature (166)..(166): n is a, c, g, or t
  modified_base (198)..(198): a, c, t, g, unknown or other
  misc_feature (198)..(198): n is a, c, g, or t
tcagagctcacgtacacgaccggtgctcgatttagctgtgcgtcgaagggaaaggggagtcagaccagtcaggacacagcatggacatgagggtccccgctcagctccgtgggctcctgctgctctggctccaggtcnccagatgtgaccacccagactgaacccngtctccatcctcctgtctgcatctggtagganacagacgtcaacctattcacgttcgaccgagggtacgtacgtccgaacggtaactagttacgtactaaactttaagtttaaaacgttggtaactcgtaaggacctaaacgggtaaaaccgagggtaaaccgtcccctaaggtcctacctagtaactacgtaacgaagtttcaccgtaactaccgttaaagttacgggaaaaccggtacggggttacccagttaaccgttaaagggttaccgtaagggttaacggtaacgggttagggtaaccgttaccggttaagggggtaaccctttaaacggtttaaccgttttttacctacccgtaaacgttacgttacgtaaaccggttacgtacgggttaacccgtacgggtaaacccttaaacgggttacgggttaaaccgtttaacggttttacccgtaaacgtttaaacccggtttaacctttaaccgttaacggtaaaccgtaaaactaacgggttaaaccggttttaaccccggtaaccccggtttaacttaacccgggttttacgggaaccccggtaaaggggttaaaccctaaacggttaaccgaccgttaaacgttacgaaaacggttaccgtgtacccggtatacccggacctaagtaccgtcgttaacttctacgtaccgttaccctaccg

SEQ ID NO: 151774 - DNA, 678 bp, Homo sapiens
  misc_feature: GYAE6OF02HJ14T.47.80.H03.1.454.CMB.1.raw
  modified_base (197)..(197): a, c, t, g, unknown or other
  misc_feature (197)..(197): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (660)..(660): a, c, t, g, unknown or other
  misc_feature (660)..(660): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtcctccttccacctgtctgcatctgtcgganacagacgtcaccatcacttgccgggccagtcagagtattgataggtggttggcctggtatcagcaagaaaccagggaaacnccctagaactctaatctanaaggctactatttagaaacgtgggtacctatcgtaagttcagtacggcagtagatcgtgggacagtacgtcaacgtctacaactactaccaaccaccctgaccgagtcctacgatcgtttaatttcggtaccgttaacgtttaaacttaccgttacgtaaacctaaaaagttaccgtaaatttacggaccgttacccgttacccgttttccggggttaacccggttaccccgtacggggtaaacccgtaaaggttacgggtaacgttacccgttaacgaaaacccgttacggttaaccggttcggggtaccttacgtaccccgtaaccgttacgtttaccgttcggtttaccttttaaccgtntttacccccgttaccccg

SEQ ID NO: 151775 - DNA, 794 bp, Homo sapiens
  misc_feature: GYAE6OF02HTQ5C.47.80.H03.1.454.CMB.1.raw
tcagagctcacgtacacgaccggtgctcgatttagctgtgcgtcgaaggggaaagggggaatcacgtacccaactcaggaccacagcatggacatgagggtcccgactcagctctggggctctgctgctctggttcccaggtgccaggtgtgacatccgagatcgaccctagtctccatcctcctgtctgccgtatcgtgtaggagacgagtcgtacgacctatcacgttggcgggcgtacgtcgagggtccgttagactaaagtggtactttacggtccttggtttaccagtacctaagtaaccaaccggtagggggaaaccggccccgtaaacggtcccgtaccgtaggtacgttacgtacggtggtacgctaacgttacctacgtttcgaacgtaagggtcggggtaccctaagttaccgtaagggttaccgacggtccggtacgtaacggttacgggttacgtcgggaacgtaaggtacgtttaccacgttaccgtacaacgtacgtacgaaccgggtcccggtccgtagaccgtacggtaccgtaaggtaacgttacggtttaccgtaacggactttaaacctttaacgtacttaccggttacctaccgttaaacgtttacgtacggtaacttcccggtaaccctttacccggttacggtaaccgttttacccgggaccggtaaacgggtaacctaacggggtaaacggtaaccgttaacggtaaaccggttaaccgttaggtaccggttaaccgttacaccggttaaccgtacgttcccggttaaccg

SEQ ID NO: 151776 - DNA, 606 bp, Homo sapiens
  misc_feature: GYAE6OF02HW6DE.47.80.H03.1.454.CMB.1.raw
  modified_base (197)..(197): a, c, t, g, unknown or other
  misc_feature (197)..(197): n is a, c, g, or t
  modified_base (422)..(422): a, c, t, g, unknown or other
  misc_feature (422)..(422): n is a, c, g, or t
  modified_base (577)..(577): a, c, t, g, unknown or other
  misc_feature (577)..(577): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagacgtcacatcacttcgccgggccagtcagagtattgataggtggttggcctggtatcgagcaagaaaccgagggaaacgccccgtagaacttacttaactactaagtaacggtcttacgttaattttaacggaaacgtcggggtaccctaagtacgtaaggttcaaggtcggacgtaggtggacttcgtaggactaggacgttcactctcacactacaacncctagcagcctagaactgtatttcggacttaacttacttaactacgaacctaaagtataaagtacgtactaccttccgttccggttccgaccgttagggaaccaaggtacgagtacgtactaacggtacgtggtacgtctacgtaccgtaccgtnttaccgtcttcttacaccgttcctacccg

SEQ ID NO: 151777 - DNA, 769 bp, Homo sapiens
  misc_feature: GYAE6OF02IDLI5.47.80.H03.1.454.CMB.1.raw
  modified_base (199)..(199): a, c, t, g, unknown or other
  misc_feature (199)..(199): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatcgacccagtctccactcctccctgtctgcatctgtagganacagagtcacctatcacttgccgggcgagtcgagggcgttgactaatcgtctttcggccttggtttcacggcacgacaccggaagggaaccggacccctaaggccgtccgtagtattcgtacgttggacgactatacttacgtttaggacgtaaagggttcgggtaccctaagttaccgtaaacgggtttccgaacggtaccgggacgtaggttaacgggttcgtaggggaactaaggtacgttctacgttctactacgttatccgacggccggtcttacgaccacggtccgtagtaaacggttctttaccgtaggtaaccttaaacgttttacttaccgtttcgttacccgttacgttaaggttaacgttacggttactttaccgtttacccggttttaaccccgttaccggggtttaaccgttttcccgggaaacccggttaaaccgggggtaacccgttaaaacggggttaacggttaaaaccgttaacccggtaaaaaccggttaaccggttacgggttacccgggaacggtttacccggaacctttaccgtacgttttaacccgg

SEQ ID NO: 151778 - DNA, 760 bp, Homo sapiens
  misc_feature: GYAE6OF02FKJF3.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtctccttccaccctgtctgctatctggtcggagacaggagtccaccatcctacgttcggcccgggacagtcagacttattgagtaggtggttcggcgttggtatcagacaaggaacgagggaacctccctagtaacttcttaatcgtaagtaaggtctacttaatttaacggaaccgttcgggtacctagttacgtaacggttcacggtaccgagtaaggtggtactacgggtagggaacgaggtacgtttacacccttactacccaccgtaactaccctaaccctaacccgcgtaccgacgtaccgttagtacgttaggttaccgtttagaccgtttaactttaacgttaaccgttacgtaaaccgttaaaagttacttaaaggttaaccgttacggtaccccgtttccgggtttaccgggtttaccccgggtacccgttaacggggtaaacccgttaaaggtacccgggtaagttaccgttaaccgtaaaccggttaccggtaggttaccgggtaccgtaccgttacccgtaccgttacgttaccggtttccgttacccgtttacccgttaccgtttccccccgttaacccg

SEQ ID NO: 151779 - DNA, 748 bp, Homo sapiens
  misc_feature: GYAE6OF02HEWXG.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctccgtggggctcctgctgctctggctcccaggtgccaaatgtgacatccagatcgacccagtcctcctccaccctgtctgcatctggtcggagacagacgtcaaccatcctacgttcggcccgggccaggtaccaggtagtattaggagttagggtggttggccgttggtacgttcacggtacaacggtaaaaacccggacggggaaaacgcccccgtaagaaccttacgttaaacttctaaagtaacggtcgttactttacgttttaaacgaaaccgttcggggttacccaattacgtaacggttacgacggtcgtactaggtaggtacttggtacggaactaggattacgaccttacacccgtaaccaaccgttaaccaacccgtacctacgaccgaccgtaccttaggattacgttagttttcggacgttaccttttaaacgtaccttaacggtaaaccttaaaaacgttaattaaacgttacgtaacgtttaccccgtaccggtttcccggtttacgggtacccggttacggtaaccgtaaaggtggtaccgtaagtaccggaaacgtaccgttgggcgtacccgtcgaccgtacttacgttacgtaccgtttctaacgtttcccaaccgttccccg

SEQ ID NO: 151780 - DNA, 799 bp, Homo sapiens
  misc_feature: GYAE6OF02HN5MZ.47.80.H03.1.454.CMB.1.raw
  modified_base (197)..(197): a, c, t, g, unknown or other
  misc_feature (197)..(197): n is a, c, g, or t
tcagagctcacgtacacgaccggtgctcgatttagctgtgcgtcgaagggaaagggggagtcagacccagtcaggacacagcatggacatgagggtcccgctcagctcctgggctcccgctgctctggctcccaggtgccaaatgtgacatccagatcgacccagtctccttccaccctgtctgcatctgtacgganacagagtcacatcacttgccgggaccagtccagacgttattgaagtaggttggtggccttggtatcgagcaacgaaacgagggaaacgcccctagaactacttaatctaacgtaaggcgtacttaacttttaaggaaaaccgttggggtacccctaagttcgtaaacggtttacgaacggtacgggactaacgtagggtacttacgtaggggtaaccaggtaacgtttaccaacgttcctaccgtaacctaacgtaaccgaaacccgtaccccgttgaccgtaacgtccgtaacgttaacgtacgttaacgttttggaaccgtttaaactttaacgtttaaccttacgtaaaccctaaaaacgttaaacgtaaaaggtttaacggttaaccgtacccgtttacccggtttacccgggttttaccccgggtaccccggttaacggggtaaaacccgttaaaacgggttacgggtaaacgtttaccgttaacggaaaaaccgtacggtttaacgggtaacggttaccgtaccggtaaccctaaccgtaacgtttaccgttacgtttaacccgtttcgtaacctttcccgtacccccggttaacc

SEQ ID NO: 151781 - DNA, 784 bp, Homo sapiens
  misc_feature: GYAE6OF02GHIKX.47.80.H03.1.454.CMB.1.raw
  modified_base (196)..(196): a, c, t, g, unknown or other
  misc_feature (196)..(196): n is a, c, g, or t
tcagagctcacgtacacgaccggtgctcgatttagctgtgcgtcgaagggaaaggggagtcagacccagtcaggacacagcatggacatgagggtccccgctcagctcctggggctcctgctgctctggctcccaggtgccaaatgtgacatccagatgacccagtctccttccaccctgtctgcatctgtcgganacgagagtcacctatcacgttcggcccgggctagtcagagtattgagtagggtggttcggcctggtatacagaccgaagaaaccgagggaaaccgcccctaagtaaccttacgttaactacgtaagtaacggtccgttaacgtttaagttttaacggaaaccggttccgggtacccctaaagttaccggtaaacggtttacgaccggccgtaccgtaggttcgggacttcggtaggggtactaagggtacttaccgacctaccgtaccgaacccgtaactaacccaacccgtacccgtaccgtaccgtacgacccgttagtaccgtttagttaaccgttttcggaccttaaccgtttacttaccgtacgtaaaccttaaaagttattaaaccggttacggttaccttaaccccgtttccgggtttaccggggtttaccccggtacccgggttaaaccgggtaacccgttaaagggtacggtaaccgttaccggtaaccgtaaaccggtaccgtacggttaaccggccttaacggacccctacgttacgttcgttacttcccgtaccttacccggttcctaacccccgg

SEQ ID NO: 151782 - DNA, 665 bp, Homo sapiens
  misc_feature: GYAE6OF02HGLR1.47.80.H03.1.454.CMB.1.raw
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttggccgggcaagtcagagcattaacagcgtatttaaattgtatcacaagaaacaggaacacccctaacctcctagactctatcgctgactatcctagtttcgactagttacgggtcggggtaccctagttacgttacgggttacgtagggttcggcgtaaggttacgggtagttccggtagggaacgtagttacttttccgtaccttcctaccgaacctactccaacgtacctagtcctacgacctaaccgtagtaacgttagtttacgaccttaaccttacttacgtacgtactaaacgtacggttaaccggttacccggttaaccccgttacgttacgttttaccgggacccgtaacgggtaccctaaacggtcgtaactaccgtaaccaaaccggtacttggtacggtcgttacggaccctaccgtacttacgttcgttaccttacc

SEQ ID NO: 151783 - DNA, 730 bp, Homo sapiens
  misc_feature: GYAE6OF02GY6L5.47.80.H03.1.454.CMB.1.raw
  modified_base (216)..(216): a, c, t, g, unknown or other
  misc_feature (216)..(216): n is a, c, g, or t
  modified_base (427)..(427): a, c, t, g, unknown or other
  misc_feature (427)..(427): n is a, c, g, or t
tcagagctcacgtacacgaccggtgctcgatttagctgtgcgtcgaagggaaagggggagtcagacccagtcaggacacagcatggacatgagggtccccgctcagctcctggggctcctgctgctctggctcccaggtcgccaaatggtagactatccagatcgacccagtcctccttccaccctgtctgcatctggtcggagacagagtcaccntcacttcggccggaccagtcagagtatgagtaggtggttcgcgtggtactcagacgaacggaaaccgacgggaacccgtcccctaagtaacccttacgttaactacgttaacggttaacgggccgttttaacgttttaaacgttttaaacggtaaccggttaccgggggtaccctaacgttacccggttaagggttacacgggtacccggngtaaggtcggtaacgttggtacggaacgtaggtacgttacctacgtacctaccgaacccagtacccctaaccctacccgtacgaccgtacggtactagtagttacgttcgtttacgacgttacttaacgttacgtacgtaaccaaagttaatacgtacgttacgtaccgttaccggttccggttccggtaccggtacggtaaaccgtaggtacgtagttacgacgtaaccgttacggtcggtacgtcgtaaccgtacaccgtagtttcctccggtttactaccgtaccgtttaccgtaccccg

SEQ ID NO: 151784 - DNA, 450 bp, Homo sapiens
  misc_feature: GYAE6OF01DW8O5.14.74.G08.1.454.CMB.1.raw
  modified_base (445)..(450): a, c, t, g, unknown or other
  misc_feature (445)..(450): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcatagnnnnnn

SEQ ID NO: 151785 - DNA, 454 bp, Homo sapiens
  misc_feature: GYAE6OF01D474A.14.74.G08.1.454.CMB.1.raw
  modified_base (449)..(454): a, c, t, g, unknown or other
  misc_feature (449)..(454): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctctttcagcctccaccaagggcccatcggtcttccccctggcaccctcctccaagagcacctctgggggcacagcggccctgggctgcctggtcaagggactacttccgtactagacgctgagcgggctgggcaaggcgcatagnnnnnn

SEQ ID NO: 151786 - DNA, 455 bp, Homo sapiens
  misc_feature: GYAE6OF01DZLP0.14.74.G08.1.454.CMB.1.raw
  modified_base (449)..(455): a, c, t, g, unknown or other
  misc_feature (449)..(455): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccggggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctgggcaaggcgcatagnnnnnnn

SEQ ID NO: 151787 - DNA, 454 bp, Homo sapiens
  misc_feature: GYAE6OF01B0OH0.14.74.G08.1.454.CMB.1.raw
  modified_base (447)..(454): a, c, t, g, unknown or other
  misc_feature (447)..(454): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaagggactacttccgtactagacgctgagcgggctggcaaggcgcatagnnnnnnnn

SEQ ID NO: 151788 - DNA, 453 bp, Homo sapiens
  misc_feature: GYAE6OF01BVB1A.14.74.G08.1.454.CMB.1.raw
  modified_base (448)..(453): a, c, t, g, unknown or other
  misc_feature (448)..(453): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctctttcagcctccaccaagggcccatcggtcttccccctggcaccctcctccaagagcacctctgggggcacagcggccctgggctgcctggtcaaggactacttccgtactagacgctgagcgggctgggcaaggcgcatagnnnnnn

SEQ ID NO: 151789 - DNA, 456 bp, Homo sapiens
  misc_feature: GYAE6OF01AN7YG.14.74.G08.1.454.CMB.1.raw
  modified_base (448)..(456): a, c, t, g, unknown or other
  misc_feature (448)..(456): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagacgcacctctgggggcacagcggccctgggctgcctggtcaaggactacttccgtactagacgctgagcgggctggcaaggcgcatagnnnnnnnnn

SEQ ID NO: 151790 - DNA, 446 bp, Homo sapiens
  misc_feature: GYAE6OF01CV115.14.74.G08.1.454.CMB.1.raw
  modified_base (438)..(446): a, c, t, g, unknown or other
  misc_feature (438)..(446): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcacgtctcttcagcctcaccaagggcccatcggtcttcccctggcaccctcctccaagagcacctctggggcacagcggccctgggctgcctggtcaaggcacttctgtactagacgctgagcggctggcaaggcgcatagnnnnnnnnn

SEQ ID NO: 151791 - DNA, 454 bp, Homo sapiens
  misc_feature: GYAE6OF01COUY0.14.74.G08.1.454.CMB.1.raw
  modified_base (446)..(454): a, c, t, g, unknown or other
  misc_feature (446)..(454): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagacgcacctctggggcacagcggccctgggctgctggtcaaggactacttccgactagacgctgagcgggctggcgaaggcgcatagnnnnnnnnn

SEQ ID NO: 151792 - DNA, 450 bp, Homo sapiens
  misc_feature: GYAE6OF01CMGLE.14.74.G08.1.454.CMB.1.raw
  modified_base (448)..(450): a, c, t, g, unknown or other
  misc_feature (448)..(450): n is a, c, g, or t
tcagcgtctagtaccacgaccggtgctcgatttagtagctctatcagggaagggacgtggagtggattggcaatatgcatgacagtgggggcaccaactacaaccccgtccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnn

SEQ ID NO: 151793 - DNA, 454 bp, Homo sapiens
  misc_feature: GYAE6OF01BVRN6.14.74.G08.1.454.CMB.1.raw
  modified_base (447)..(454): a, c, t, g, unknown or other
  misc_feature (447)..(454): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagacgcacctctggggcacagcggccctgggctgcctggtcaaggactacttccgtactagacgctgagcgggctggcaaggcgcatagnnnnnnnn

SEQ ID NO: 151794 - DNA, 453 bp, Homo sapiens
  misc_feature: GYAE6OF01BDROR.14.74.G08.1.454.CMB.1.raw
  modified_base (447)..(453): a, c, t, g, unknown or other
  misc_feature (447)..(453): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaagggactacttccgtactagacgctgagcgggctggcaaggcgcatagnnnnnnn

SEQ ID NO: 151795 - DNA, 459 bp, Homo sapiens
  misc_feature: GYAE6OF01BQ2SG.14.74.G08.1.454.CMB.1.raw
  modified_base (449)..(459): a, c, t, g, unknown or other
  misc_feature (449)..(459): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggccacccctcctccaagacgcacctctgggggcacagcggccctgggctgcctggtcaaggctacttccgtactagacgctgagcgggctggcaaggcgcatagnnnnnnnnnnn

SEQ ID NO: 151796 - DNA, 454 bp, Homo sapiens
  misc_feature: GYAE6OF01CTM18.14.74.G08.1.454.CMB.1.raw
  modified_base (448)..(454): a, c, t, g, unknown or other
  misc_feature (448)..(454): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctgggcaaggcgcatagnnnnnnn

SEQ ID NO: 151797 - DNA, 453 bp, Homo sapiens
  misc_feature: GYAE6OF01CKSC4.14.74.G08.1.454.CMB.1.raw
  modified_base (446)..(453): a, c, t, g, unknown or other
  misc_feature (446)..(453): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcatagnnnnnnnn

SEQ ID NO: 151798 - DNA, 374 bp, Homo sapiens
  misc_feature: GYAE6OF01CRD80.14.74.G08.1.454.CMB.1.raw
  modified_base (373)..(374): a, c, t, g, unknown or other
  misc_feature (373)..(374): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnn

SEQ ID NO: 151799 - DNA, 468 bp, Homo sapiens
  misc_feature: GYAE6OF01A22OS.14.74.G08.1.454.CMB.1.raw
  modified_base (448)..(468): a, c, t, g, unknown or other
  misc_feature (448)..(468): n is a, c, g, or t
tcagcgtctagtaccacgaccggtgctcgatttagtagctctatcagggaaggggactggagtggattggcaatatgcatgacagttgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaacgagcacctctgggggcacagcggccctgggctgcctggtcaaggactacttccgtactagacgctgagcgggctggcaggcgcatagnnnnnnnnnnnnnnnnnnnnn

SEQ ID NO: 151800 - DNA, 511 bp, Homo sapiens
  misc_feature: GYAE6OF01DO1T7.14.74.G08.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (484)..(511): a, c, t, g, unknown or other
  misc_feature (484)..(511): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacgacggccgcgttatttctgtgcgacggaccgggagtacggttttactatagaaaaggtcgtctgcacatattgttggttggtttgatgtcgtgggccgagggacagtgtcacgtctctcacgcctccacgacggccagtccgtccttccccgngccaccctcctcaacgcnccacctcggcggggcacgacggccggccgtgggcctcgccgttgggtcgacggtaccttaccgttccgtactacggccgtcgtaggacggccgggcgtcgggacgaacgggccgacgagtcgnnnnnnnnnnnnnnnnnnnnnnnnnnnn

SEQ ID NO: 151801 - DNA, 505 bp, Homo sapiens
  misc_feature: GYAE6OF01D76MF.14.74.G08.1.454.CMB.1.raw
  modified_base (488)..(505): a, c, t, g, unknown or other
  misc_feature (488)..(505): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggtggttttgatgtcgtggggccaggggacaatggtcaccgtctcttcagcctccaccgaacgggcccatccggtccttcccctggccacccctcctccaagcgcacctcgtgggggcacgacggccggcccgtgggcctggcctgggtcaacgggtaccttaccttcccgtactacggacgtcgtggacggcggggcctgggaccgaacgggccgacataggcnnnnnnnnnnnnnnnnnn

SEQ ID NO: 151802 - DNA, 381 bp, Homo sapiens
  misc_feature: GYAE6OF01B5TKJ.14.74.G08.1.454.CMB.1.raw
  modified_base (365)..(365): a, c, t, g, unknown or other
  misc_feature (365)..(365): n is a, c, g, or t
  modified_base (371)..(381): a, c, t, g, unknown or other
  misc_feature (371)..(381): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggctactccgtactagacgctgagcgggctggcaaggcncatagnnnnnnnnnnn

SEQ ID NO: 151803 - DNA, 459 bp, Homo sapiens
  misc_feature: GYAE6OF01BY3VN.14.74.G08.1.454.CMB.1.raw
  modified_base (450)..(459): a, c, t, g, unknown or other
  misc_feature (450)..(459): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggtttgatgtctggggccagggggacaatggtcaccgtctcttcagcctccaccaagggcccatcggtcttcccctggcaccctcctccaagacgcacctcgtcgggggcacgagcggccctgggctgcctggtcaaggactacttccgtactagacgctgagcgggctgggcaaggcgcatagnnnnnnnnnn

SEQ ID NO: 151804 - DNA, 628 bp, Homo sapiens
  misc_feature: GYAE6OF01ACDLF.14.74.G08.1.454.CMB.1.raw
  modified_base (204)..(204): a, c, t, g, unknown or other
  misc_feature (204)..(204): n is a, c, g, or t
  modified_base (597)..(597): a, c, t, g, unknown or other
  misc_feature (597)..(597): n is a, c, g, or t
  modified_base (599)..(628): a, c, t, g, unknown or other
  misc_feature (599)..(628): n is a, c, g, or t
tcagcgtctagtaccacgaccggtgctcgatttagtagctctatcagggaagggactggagtggattggcaatatgcatgacagtggggcaccaactacaacccctcctcaagagtcgagtcaccttatcactagacgcgtccaagaagcagttctccctgaagctgagctctgtgaccgccgcagacacggccgcgtatttcngtgcgacgacccgggagtacgtttactatagtaaaagtcgttactgctacattagttggttggttgtttgagtgtcgtggggaccaggggactaagtcggtaccaccgttctccgttcgacgccctaccaaccgaaccgggcccctacgttcccggttccccttccccccgtggacccctacccccgttccgtaacccgaaaggtaccgacccgtaacccgtcgggtacggggggaccaacggcccggtccgggtccccggtgggtacccgtaccggtaccggttacgggtaaccgtaaacggggttaccctttaacccggttaccggttaaccgtaacggccgtcgtacggaacggcccgggttcgtacgggacggaacggcgacgtaaggngnnnnnnnnnnnnnnnnnnnnnnnnnnnnnn

SEQ ID NO: 151805 - DNA, 467 bp, Homo sapiens
  misc_feature: GYAE6OF01A1ENQ.14.74.G08.1.454.CMB.1.raw
  modified_base (459)..(467): a, c, t, g, unknown or other
  misc_feature (459)..(467): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagtacggttttactatagaaaaggtcgttctgcacatattgttggtggttttgatgtctggggccaggggacaatggtcaccgtctcttcagcctccaccaacgggcccatcggtcttccccctggccacccctcctccaagacgcaccctcgtgggggcacgagcggcccgtggggctgccctggtcaacggactacttccgtactagacgctgaggcgggctggcaaggcgcatagnnnnnnnnn

SEQ ID NO: 151806 - DNA, 565 bp, Homo sapiens
  misc_feature: GYAE6OF01DJR89.14.74.G08.1.454.CMB.1.raw
  modified_base (540)..(542): a, c, t, g, unknown or other
  misc_feature (540)..(542): n is a, c, g, or t
  modified_base (544)..(565): a, c, t, g, unknown or other
  misc_feature (544)..(565): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggtggttttgatgtcgtggggccaggggacaagtggtcaccgtctcttcagccctccaccgaacggcccatccggtccttccccctggccacccctcctccaagacgccacctcgtcgggggcacgacggtcggcccgtggggcctcggcccgttgggtaccgtaaacgggtaccttaacccgtttcccggttaaccgttaacggaaccggtccgttacggaacgggtccgggggtccgtcggggaccgaaacggggtccgacctaagttagcgnnngnnnnnnnnnnnnnnnnnnnnnn

SEQ ID NO: 151807 - DNA, 509 bp, Homo sapiens
  misc_feature: GYAE6OF01CPC0X.14.74.G08.1.454.CMB.1.raw
  modified_base (492)..(509): a, c, t, g, unknown or other
  misc_feature (492)..(509): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatccggtcttccccctggccacccctcctccaagacgccaccctcgtcgggggccacgacggccggccccgtggggcctggccctgggtccaagggaccttaccttccgtaccgtagacgcgtaggacggcggggctcggggaccgtaagggccgacagtacgnnnnnnnnnnnnnnnnnn

SEQ ID NO: 151808 - DNA, 532 bp, Homo sapiens
  misc_feature: GYAE6OF01CUEND.14.74.G08.1.454.CMB.1.raw
  modified_base (207)..(207): a, c, t, g, unknown or other
  misc_feature (207)..(207): n is a, c, g, or t
  modified_base (501)..(506): a, c, t, g, unknown or other
  misc_feature (501)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(515): a, c, t, g, unknown or other
  misc_feature (513)..(515): n is a, c, g, or t
  modified_base (517)..(532): a, c, t, g, unknown or other
  misc_feature (517)..(532): n is a, c, g, or t
tcagcgtctagtaccacgaccggtgctcgatttagtagctctatcagggaaggggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttcngtgcgagacccgggagtacggttttactatagaaaaaggtcgttctgcacatattgttggtgttttgattgtcgtggggccaggggacaagtggtcaccgtctctttcagcctccaccaacgggcccatccggtccttccccctggccacccctcctcaacgacgccaaccgtcgtcggggcacgacggccggcccgtggggcctcggcctgggtaccaacggtacttaccgttccgtactacgacgcgttggacggcgggcgtcggacgaacggcgctaagtaggactgcagnnnnnngcncngnnngnnnnnnnnnnnnnnnn

SEQ ID NO: 151809 - DNA, 537 bp, Homo sapiens
  misc_feature: GYAE6OF01D4HI8.14.74.G08.1.454.CMB.1.raw
  modified_base (511)..(514): a, c, t, g, unknown or other
  misc_feature (511)..(514): n is a, c, g, or t
  modified_base (516)..(537): a, c, t, g, unknown or other
  misc_feature (516)..(537): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaggtcgttctgcacatattgttggttggttttgatgtcgtggggccaggggacaagtggtcaccgtctcttcacgcctccaccgacggcccagtccggtccttcccccgtggccctacccctcctacccaagacgccaccgtcgtgggggccacgacggccggcccgtgggctcggccgttgggtaccgaacggtaccttaccgttcccgttaacgtacgaccgtcgtcggacggccggggtctcgggacgaacgggccgacgagtagnnnngnnnnnnnnnnnnnnnnnnnnnn

SEQ ID NO: 151810 - DNA, 448 bp, Homo sapiens
  misc_feature: GYAE6OF01EQQ1A.14.74.G08.1.454.CMB.1.raw
  modified_base (443)..(448): a, c, t, g, unknown or other
  misc_feature (443)..(448): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcacccctctccaagagcacctctggggcacagcgccctgggctgcctggtcaaggctacttccgtactagacgctgagcgggctggcaaggcgcatagnnnnnn

SEQ ID NO: 151811 - DNA, 465 bp, Homo sapiens
  misc_feature: GYAE6OF01B895C.14.74.G08.1.454.CMB.1.raw
  modified_base (455)..(465): a, c, t, g, unknown or other
  misc_feature (455)..(465): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggccaccctcctccaagacgcacctcgtgggggccacgacgcggccccgtgggcctgcctgggtcaaggactacttccgtactagacgctgagcgggctggcaggcgcatagnnnnnnnnnnn

SEQ ID NO: 151812 - DNA, 467 bp, Homo sapiens
  misc_feature: GYAE6OF01ETZXF.14.74.G08.1.454.CMB.1.raw
  modified_base (457)..(467): a, c, t, g, unknown or other
  misc_feature (457)..(467): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaagtggtcaccgtctcttcagcctccaccaagggcccatcggtcttccccctggccaccctcctccaagacgcacctcgtgggggcacgagccggcccgtgggctgcctggtcaacgggactacttccgtactacgacgctgagcgggctgggcaaggcgcatagnnnnnnnnnnn

SEQ ID NO: 151813 - DNA, 530 bp, Homo sapiens
  misc_feature: GYAE6OF01DWBQ4.14.74.G08.1.454.CMB.1.raw
  modified_base (506)..(530): a, c, t, g, unknown or other
  misc_feature (506)..(530): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggtggttttgatgtcgtggggccaggggacatggtcacgtctcttcacgcctccaccgaacgggcccagtccggtcccttcccccgtggccctacccctccctaccaacggacgccaccgtcgtgggggccacgacggccggtcccgtgggctcgccgtagggtacaacgggtaccttaccgttccgtaacgtagaccgtcgtggaggccgggcgtcgggacgaacgggcgacaagtcgannnnnnnnnnnnnnnnnnnnnnnnn

SEQ ID NO: 151814 - DNA, 526 bp, Homo sapiens
  misc_feature: GYAE6OF01BT1DI.14.74.G08.1.454.CMB.1.raw
  modified_base (504)..(526): a, c, t, g, unknown or other
  misc_feature (504)..(526): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtgaccgccgcagacacggccgcgtattctgtgcgagaccgggagtacggtttactatagaaaaaggtcgttactgacacattagttgttggttggtttttgagttgtcgtggggccaaggggacaagtggtcaccgtctcttcacgtcctccaaccgaacgggcccagtccggttccttcccccgtcggccacccctcctaccaagacgccaccgtcgtgggggccacgacgccggcctcgggctgccgtggttacgaaaggtactacctttaccggtacgtacgaccgtctaggacggcgggctcgggacaagggccgacgagtaggnnnnnnnnnnnnnnnnnnnnnnn

SEQ ID NO: 151815 - DNA, 489 bp, Homo sapiens
  misc_feature: GYAE6OF01CCRAF.14.74.G08.1.454.CMB.1.raw
  modified_base (474)..(489): a, c, t, g, unknown or other
  misc_feature (474)..(489): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccaggggacaagtggtcaccgtctcttcagcctccaccaagggcccatccggtcttccccctggccaccctcctccaagacgccacctcgtcggggcacgacgccggcccgtgggctcggcctgggtaccaaggtcctactttcccgtactacgaccgctggacggcgggctgggcgaaggccgcactagnnnnnnnnnnnnnnnn

SEQ ID NO: 151816 - DNA, 451 bp, Homo sapiens
  misc_feature: GYAE6OF01DABW3.14.74.G08.1.454.CMB.1.raw
  modified_base (355)..(355): a, c, t, g, unknown or other
  misc_feature (355)..(355): n is a, c, g, or t
  modified_base (445)..(451): a, c, t, g, unknown or other
  misc_feature (445)..(451): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctcaccaaggccatcggtcttcccctggccaccctcctcaagngccacctcgtgggggcacagcggccctgggctgcctggtcaaggactacttccgtactagacgctgagcgggctgggcaaggcgcatagnnnnnnn

SEQ ID NO: 151817 - DNA, 556 bp, Homo sapiens
  misc_feature: GYAE6OF01CJE59.14.74.G08.1.454.CMB.1.raw
  modified_base (206)..(206): a, c, t, g, unknown or other
  misc_feature (206)..(206): n is a, c, g, or t
  modified_base (280)..(280): a, c, t, g, unknown or other
  misc_feature (280)..(280): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
  modified_base (525)..(556): a, c, t, g, unknown or other
  misc_feature (525)..(556): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgcgcagacacggccgcgtatttcngtgcgagacccgggggagttacgtttatagtaaaggtaaacgttctgtcacatattgttgttggtttgtttagngtcgttgggcggacggaggaactagtcgtaccgtcttctctacacgtcctaccgacggaccgacctgtccgttcccttcccgngcccctacctccctaacgacgcaccaccgttcggggacggaccacggcggccgtcccgggngtaccgtcgtcggtacggtacgaaccgtactttccgttaaccgtagtaaccggccgtgtacggccgggtacggttcgacgaacggacgggccagtaacggnnnnnnnnnnnnnnnnnnnnnnnnnnnnnnnn

SEQ ID NO: 151818 - DNA, 539 bp, Homo sapiens
  misc_feature: GYAE6OF01B9OR7.14.74.G08.1.454.CMB.1.raw
  modified_base (516)..(539): a, c, t, g, unknown or other
  misc_feature (516)..(539): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggttggttttgatgtcgtggggccaggggacaagtggtcaccgtctcttcacgccctccaccgaacgggcccagtccggttcccttccccccgtcggcccaccccttccctacccgaaacgacgccaccgtcggtcgggggccacgacggccggcccgtggggctcggccgtggtaccaacgggtaccttaccgttccgtactacgaccgcgtacggacggccgggcgtcgggacgaacgggcgcagtagcnnnnnnnnnnnnnnnnnnnnnnnn

SEQ ID NO: 151819 - DNA, 486 bp, Homo sapiens
  misc_feature: GYAE6OF01ENXFO.14.74.G08.1.454.CMB.1.raw
  modified_base (314)..(314): a, c, t, g, unknown or other
  misc_feature (314)..(314): n is a, c, g, or t
  modified_base (366)..(366): a, c, t, g, unknown or other
  misc_feature (366)..(366): n is a, c, g, or t
  modified_base (467)..(486): a, c, t, g, unknown or other
  misc_feature (467)..(486): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggtggtttgatgtcgtggggccgaggggacaagtggtcaccgtctcttcngcctccaccgaaggcccatcggtccttcccctcggcaccctcctccaagacncacctcgtggggcacgacgcgcccgtgggctcgcctggtacaacggtactacgttccgtacgtagacgcgtggacggcgggcgtgggcgaaggcgcatagnnnnnnnnnnnnnnnnnnnn

SEQ ID NO: 151820 - DNA, 471 bp, Homo sapiens
  misc_feature: GYAE6OF01DLQEK.14.74.G08.1.454.CMB.1.raw
  modified_base (459)..(471): a, c, t, g, unknown or other
  misc_feature (459)..(471): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtattctgtgcgagacccgggagacggttttactatgaaaaaggtcgttctgcacatattgttggtggttttgatgtcgtggggccaggggacaagtggtcaccgtctcttcagcctccaccgaacgggcccatccggtccttcccccgtggccacccctcctccaagcgccaccgtcgtcgggggcacgagccggcctgggctgcctggcaaggactacttccgtactagacgctgagcgggctggcgaaggcgcatagnnnnnnnnnnnnn

SEQ ID NO: 151821 - DNA, 473 bp, Homo sapiens
  misc_feature: GYAE6OF01B2I4T.14.74.G08.1.454.CMB.1.raw
  modified_base (461)..(473): a, c, t, g, unknown or other
  misc_feature (461)..(473): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggtggtttgatgtcgtggggccaggggacaagtggtcaccgtctcttcagcctccaccaagggcccatccggtccttccccctggccacccctcctccaagacgccacctcgtgggggcacgagccggccctgggctcggcctggtcaacggactacttccgtactagacgcgtgagcgggcgtggcaggcgcatagnnnnnnnnnnnnn

SEQ ID NO: 151822 - DNA, 556 bp, Homo sapiens
  misc_feature: GYAE6OF01B5TNE.14.74.G08.1.454.CMB.1.raw
  modified_base (535)..(556): a, c, t, g, unknown or other
  misc_feature (535)..(556): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggttcgttctgcacatattgttggttggttttgatgtcgtgggccgaggggacaagtggtcaccgtctcttcacgccctccaaccgaacgggccccagttcccggttcccttccccccgtgggtccctaccccctccctaccgaaacgcgccacccgtcggtcgggggacacgacggccggtcccgtggggcctcgcccgtggtaccgaacggtaccttaccgttacccgtaacgtacgaccggtcgtacggacgggcgggcgtacgggacggtaacgggccgacgagtagnnnnnnnnnnnnnnnnnnnnnn

SEQ ID NO: 151823 - DNA, 468 bp, Homo sapiens
  misc_feature: GYAE6OF01BW3JF.14.74.G08.1.454.CMB.1.raw
  modified_base (456)..(468): a, c, t, g, unknown or other
  misc_feature (456)..(468): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatccggtcttccccctggccacccctcctccaagacgccacctcgtgggggcacgagcggccctgggctgcctggtcaaggtactacttccgtactagacgctgagcgggcgtggcaaggcgcatagnnnnnnnnnnnnn

SEQ ID NO: 151824 - DNA, 478 bp, Homo sapiens
  misc_feature: GYAE6OF01DT2VE.14.74.G08.1.454.CMB.1.raw
  modified_base (465)..(478): a, c, t, g, unknown or other
  misc_feature (465)..(478): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctctcagcctcaccaaggccatcgtctcccctggcacctctccagacgcactcgtggggcacacgccggccctcggggctcggccttgggtacaaaggacttaaccgttcccgttaacgtacgaacgcgtgaaggcgggccgtgggacaagggcgcactagnnnnnnnnnnnnnn

SEQ ID NO: 151825 - DNA, 557 bp, Homo sapiens
  misc_feature: GYAE6OF01C6CR7.14.74.G08.1.454.CMB.1.raw
  modified_base (206)..(206): a, c, t, g, unknown or other
  misc_feature (206)..(206): n is a, c, g, or t
  modified_base (533)..(557): a, c, t, g, unknown or other
  misc_feature (533)..(557): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttcngtgcgagacccgggagtacggttttactatagaaaaaggtcgttctgcacatattgttggttggttttgatgtcgtggggccaggggacaagtggtcaccgtctcttcacgcctcaccgaagggccctagtccggtccttcccccgtggcccacccctccctaccaacgacgccacccgtcggtcgggggccacgacggccggtccccgtgggccttcggcccgttgggtaccgaacggtacctttaaccgtttcccgtaacgtacggaaccgtcgtacggtacgggcgggtccgtacgggacgaaaggggccgacgtaagtaggcnnnnnnnnnnnnnnnnnnnnnnnnn

SEQ ID NO: 151826 - DNA, 555 bp, Homo sapiens
  misc_feature: GYAE6OF01AU8SJ.14.74.G08.1.454.CMB.1.raw
  modified_base (352)..(352): a, c, t, g, unknown or other
  misc_feature (352)..(352): n is a, c, g, or t
  modified_base (525)..(525): a, c, t, g, unknown or other
  misc_feature (525)..(525): n is a, c, g, or t
  modified_base (528)..(555): a, c, t, g, unknown or other
  misc_feature (528)..(555): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcggacgaccgggagtacggttttactatagaaaaggtcgttctgcacatattgttggttggttttgattgtcgtggggccgagggacaagttggtcaccgtcttctcacgcctccacgacggcccagtccgtccttccccgnggccacccctcctccaagacgccaccctcggtcgggggccacgacggcccggtcccgtcgggtccgtcggccgttcgggtaccgaaacgggtacctttaccgttcccgttaactacggacgtcgtaggacgggcggggtcgtcgggaccgtaagggccgacgaagtaggcagngcnnnnnnnnnnnnnnnnnnnnnnnnnnnn

SEQ ID NO: 151827 - DNA, 554 bp, Homo sapiens
  misc_feature: GYAE6OF01BBLT7.14.74.G08.1.454.CMB.1.raw
  modified_base (521)..(521): a, c, t, g, unknown or other
  misc_feature (521)..(521): n is a, c, g, or t
  modified_base (525)..(554): a, c, t, g, unknown or other
  misc_feature (525)..(554): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactagtagaaaaaggtcgttactgcacatagttgttggttggttttgagttgtcgttggggcccgaggggacaagtcggtcaccgttctcttcacgcctccaccgtaacgggcccagtccggtccttccccgtggcctaccctcctaccgaacgtacgcacctcggtcgggcacgaggccggcccgttcgggcctcggcccgttacggtaccgaagggtaccttaccgttcccgtaacgtaacggcgtcgtacggacggtccgggctgggacgaaggcgacctaagtgnacgnnnnnnnnnnnnnnnnnnnnnnnnnnnnnn

SEQ ID NO: 151828 - DNA, 515 bp, Homo sapiens
  misc_feature: GYAE6OF01BZHRF.14.74.G08.1.454.CMB.1.raw
  modified_base (497)..(515): a, c, t, g, unknown or other
  misc_feature (497)..(515): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggttggttttgagttgtcgtggggccgaggggacaagtggtcaccgtctctcacgcctccaccgaacggcccatccggtccttcccccgtggcccacccctcctaccgaagacgccacccgtcggtacggggccacgacggccggcccgtgggctcggcctggtaccaaggtacctacttccgtactacgacgcgtaggacggcggcgtggaccgtaaggcgactagtacgnnnnnnnnnnnnnnnnnnn

SEQ ID NO: 151829 - DNA, 383 bp, Homo sapiens
  misc_feature: GYAE6OF01ES6TA.14.74.G08.1.454.CMB.1.raw
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
  modified_base (373)..(383): a, c, t, g, unknown or other
  misc_feature (373)..(383): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccctntggcaccctcctccaagagcacctctgggggcacagcggccctgggctgcctggtcaaggctacttccgtatagacgtctgagcgggctggcaaggcgnactagnnnnnnnnnnn

SEQ ID NO: 151830 - DNA, 523 bp, Homo sapiens
  misc_feature: GYAE6OF01BDDC6.14.74.G08.1.454.CMB.1.raw
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (499)..(523): a, c, t, g, unknown or other
  misc_feature (499)..(523): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggttggttttgatgtcgtggggccgaggggacaagtggtcaccgtctcttcgcgcctccaccgaagggcccagtccggtccttcccccgtggccacccctcctaccaagacgccacctcggtcggggcacgacggccggcccgtcgggcgtcgccgtgggtacgaacggtacctacgttaccgtacgtagaccgtcgtacggaggccggngtacgggacaggccganagtacgnnnnnnnnnnnnnnnnnnnnnnnnn

SEQ ID NO: 151831 - DNA, 517 bp, Homo sapiens
  misc_feature: GYAE6OF01CHSWM.14.74.G08.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (497)..(517): a, c, t, g, unknown or other
  misc_feature (497)..(517): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaggtcgttctgcacatattgttggttgttttgatgtcgtggggccgaggggacaagtggtctaccgtcttcttcncgcctccaccgacggcccagtccggtccttccccctggccncccctcctaccgaacgcgccaccgtcgcggggcacgacgccggcccgtgggcctcggccgtggtaccgaacggtacctaccttccggtactacggacgcgtaggacgggccgggcgtcgggcgaacgggcgacagtagnnnnnnnnnnnnnnnnnnnnn

SEQ ID NO: 151832 - DNA, 593 bp, Homo sapiens
  misc_feature: GYAE6OF01ALZ3M.14.74.G08.1.454.CMB.1.raw
  modified_base (175)..(175): a, c, t, g, unknown or other
  misc_feature (175)..(175): n is a, c, g, or t
  modified_base (414)..(414): a, c, t, g, unknown or other
  misc_feature (414)..(414): n is a, c, g, or t
  modified_base (564)..(593): a, c, t, g, unknown or other
  misc_feature (564)..(593): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctntgtgacccgccgcagacgaccggccgtcgtatttcgtgtgcgacggaccgggagtacggttttacagtagaaaaggtcttctgcactattagtttggtttggttggttttgagttcgtcggtggggccgaaggggtacaagttcggtcctaccgttcttccttcgacgtccctaccgaaccgaacgggccctacgtccggttcccttcccccgtggcccctacccctcctaccgaagcncccgtaccgtcgggtcggggactacggaccggcccggtcccgtcgggtcctcggtcccggtggtaccaacgggtacccttaccgttacccgtacgtacggaccgcgtaggacgggtccggtacgtacggacgaacgggcgacgagtagcnnnnnnnnnnnnnnnnnnnnnnnnnnnnnn

SEQ ID NO: 151833 - DNA, 554 bp, Homo sapiens
  misc_feature: GYAE6OF01EG10R.14.74.G08.1.454.CMB.1.raw
  modified_base (528)..(554): a, c, t, g, unknown or other
  misc_feature (528)..(554): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggttggttttgatgtcgtggggccaggggacaagtggtcaccgtctctcgacgcctccgaccgaacgggccctagtccggttccttcccccgtggccctaccccgttcctacccgaagacgcctacccgtcggtcgggggacacgacggccggacccgtcgggcctcggccgttgggtacgaacgggtacctttaaccgttcccgtaacgtacgtaccgtcgtaggacggccgggcgttgggacgaacgggcgactagtagcnnnnnnnnnnnnnnnnnnnnnnnnnnn

SEQ ID NO: 151834 - DNA, 453 bp, Homo sapiens
  misc_feature: GYAE6OF01B7L6G.14.74.G08.1.454.CMB.1.raw
  modified_base (443)..(443): a, c, t, g, unknown or other
  misc_feature (443)..(443): n is a, c, g, or t
  modified_base (447)..(453): a, c, t, g, unknown or other
  misc_feature (447)..(453): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccagggggacaatggtcaccgtctcttcagcctccaccaagggcccatcggtcttccccctggccacctcctcaagagcacctctcggggcacgacgcggccctgggctgcctggtcaaggactacttccgtactagacgctgagcggctgcaaggcgcntagnnnnnnn

SEQ ID NO: 151835 - DNA, 519 bp, Homo sapiens
  misc_feature: GYAE6OF01CYICX.14.74.G08.1.454.CMB.1.raw
  modified_base (354)..(354): a, c, t, g, unknown or other
  misc_feature (354)..(354): n is a, c, g, or t
  modified_base (457)..(457): a, c, t, g, unknown or other
  misc_feature (457)..(457): n is a, c, g, or t
  modified_base (493)..(519): a, c, t, g, unknown or other
  misc_feature (493)..(519): n is a, c, g, or t
tcagcgtctagtaccacgaccggtgctcgatttagtagctctatcagggaagggactggagtggattggcaatatgcatgacagtggggcaccaactacaaccccctccctcaagagtcgagtcaccttatcactagacgcgtaccaagaagcagttctccctgaagctgagctctgtgaccgccgcagacacggccgcgtattctgtcgcgacgaccgggagtacggtttactatagaaaaggtcgtctgcactatagttgttagggttggttttgagttgtcgtgggccgagggacagtcgtcacgtctctcacgccctaccgaccgacggcctacgtccgtccttccccgnggcccacctcctacgaacgacacctaccgtcgtcggggcctaacgcggcggtccgtgggccgtcgccgtcggtacaaggtacctctaccgtaacgtagaccgngtacgacggccggtgacgaccgaaggctgaactgannnnnnnnnnnnnnnnnnnnnnnnnnn

SEQ ID NO: 151836 - DNA, 814 bp, Homo sapiens
  misc_feature: GYAE6OF01CUQR1.14.74.G08.1.454.CMB.1.raw
  modified_base (769)..(769): a, c, t, g, unknown or other
  misc_feature (769)..(769): n is a, c, g, or t
  modified_base (774)..(774): a, c, t, g, unknown or other
  misc_feature (774)..(774): n is a, c, g, or t
  modified_base (780)..(780): a, c, t, g, unknown or other
  misc_feature (780)..(780): n is a, c, g, or t
  modified_base (782)..(782): a, c, t, g, unknown or other
  misc_feature (782)..(782): n is a, c, g, or t
  modified_base (787)..(788): a, c, t, g, unknown or other
  misc_feature (787)..(788): n is a, c, g, or t
  modified_base (790)..(790): a, c, t, g, unknown or other
  misc_feature (790)..(790): n is a, c, g, or t
  modified_base (792)..(793): a, c, t, g, unknown or other
  misc_feature (792)..(793): n is a, c, g, or t
  modified_base (795)..(798): a, c, t, g, unknown or other
  misc_feature (795)..(798): n is a, c, g, or t
  modified_base (800)..(809): a, c, t, g, unknown or other
  misc_feature (800)..(809): n is a, c, g, or t
  modified_base (811)..(812): a, c, t, g, unknown or other
  misc_feature (811)..(812): n is a, c, g, or t
  modified_base (814)..(814): a, c, t, g, unknown or other
  misc_feature (814)..(814): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttcctccctgaagctgagctctgtcgacccgccgcgagacaccggccgtcgttactttctggtgacggacggaccgggagtacggttttactagtaagaaaacggttcgttctgacactagttagttggtttgggtttggttttagtaggttcggttcggtcgggggtaccggaaggggtaacgtaagttccgggtaccgtacccggttccttccgtttaccgacccggtaccccttacccggaaacccgggtaaccgggtaccccgttaaccgggtttccccggtttaccccccgtttcccccccgggtccggtaccccccgttaaccccccgttacccccgttacccgaaaccggtacccgtacccccgtacccggtttcccgggggaccggggtacccgaacccggacccgggtccccgggtacccggttccggggtccgttcccggtacccggttaccgggtaaccggtaaaccgggtttccccgtttaaccggtttacccccggttaacggtaacccggtaaccgggtccggttaaccgggggacggggtcccggggacccggttcgggggaaacccgtaacggggcccggaacggttacggtaacggngacgngtgacngngacgnnancnngnnnngnnnnnnnnnncnngn

SEQ ID NO: 151837 - DNA, 533 bp, Homo sapiens
  misc_feature: GYAE6OF01BFB0H.14.74.G08.1.454.CMB.1.raw
  modified_base (251)..(251): a, c, t, g, unknown or other
  misc_feature (251)..(251): n is a, c, g, or t
  modified_base (470)..(470): a, c, t, g, unknown or other
  misc_feature (470)..(470): n is a, c, g, or t
  modified_base (510)..(533): a, c, t, g, unknown or other
  misc_feature (510)..(533): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaggtcgttntgcacatattgttggtgttttgatgtctggggcaggggacaatggtcaccgtctcttcagcctccaccgaacggccccagtccggttcccttccccccgtggtccccacccctccctcccaagacgccaccgtcggtcggggcacgacggccggcccgtcgggctcgccgtggtacaacggtaccttaccgttcccgtaacgtacgaccgtcgtacggnggccggggtctacgggacgtaaacgggccgactacgtagnnnnnnnnnnnnnnnnnnnnnnnn

SEQ ID NO: 151838 - DNA, 710 bp, Homo sapiens
  misc_feature: GYAE6OF01C3E41.14.74.G08.1.454.CMB.1.raw
  modified_base (207)..(207): a, c, t, g, unknown or other
  misc_feature (207)..(207): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (675)..(676): a, c, t, g, unknown or other
  misc_feature (675)..(676): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
  modified_base (684)..(685): a, c, t, g, unknown or other
  misc_feature (684)..(685): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (694)..(695): a, c, t, g, unknown or other
  misc_feature (694)..(695): n is a, c, g, or t
  modified_base (697)..(701): a, c, t, g, unknown or other
  misc_feature (697)..(701): n is a, c, g, or t
  modified_base (703)..(705): a, c, t, g, unknown or other
  misc_feature (703)..(705): n is a, c, g, or t
  modified_base (707)..(707): a, c, t, g, unknown or other
  misc_feature (707)..(707): n is a, c, g, or t
  modified_base (709)..(709): a, c, t, g, unknown or other
  misc_feature (709)..(709): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctcctgaagctgagctctgtgaccgccgcagacacggccgcgttatttcgngtgcgacgaccgggtagtacggttttactatagaaaaggtcgttctgctactagtagttggttgggttggttttcgagttggtcgtcggggccgaggggaactaagtcggtcaccggttctacttcgaccgtacctaccaaccggtacgggacccctacggttcccggttaccccgttaccccccgttcgggacccctacccccgttacccgttaccccgaaaggtacccgtaccgtaaccccggtcggggtaccggggggaccaaacgggccggtcccggggtccccggttagggggcccgttacggtcccgttacggggtaccgtaaacggggtaccctttacccgttttacccggtaacgttaccgggaccggttacggtacggggtacgggtaccggggaccgtttaggggaaaccccgtaaggggtaccccacggttaagagggctacggangccngngtcgnngcgngngnngngngngcnngnnnnncnnngngng

SEQ ID NO: 151839 - DNA, 521 bp, Homo sapiens
  misc_feature: GYAE6OF01BT9NK.14.74.G08.1.454.CMB.1.raw
  modified_base (354)..(354): a, c, t, g, unknown or other
  misc_feature (354)..(354): n is a, c, g, or t
  modified_base (501)..(521): a, c, t, g, unknown or other
  misc_feature (501)..(521): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgttatttctgtgcgagacccgggagtacggttttactatagaaaaaggtcgttctgcacatattgttggttggttttgattgtcgtggggccgaggggacaagtggtcaccgtctcttcacgcctccaccgacgggccagtccggtccttccccgngccacccctcctccaagacgccacctcggtcggggcacgacggccggcccgtgggcctcggccgtaggtaccgaacggtaccttacgttaccgtacgtacggtaccgcgtggacggcgggtcgtcgggacgaagggcgacagtacgnnnnnnnnnnnnnnnnnnnnn

SEQ ID NO: 151840 - DNA, 663 bp, Homo sapiens
  misc_feature: GYAE6OF01ATLT4.14.74.G08.1.454.CMB.1.raw
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
  modified_base (634)..(634): a, c, t, g, unknown or other
  misc_feature (634)..(634): n is a, c, g, or t
  modified_base (639)..(640): a, c, t, g, unknown or other
  misc_feature (639)..(640): n is a, c, g, or t
  modified_base (643)..(643): a, c, t, g, unknown or other
  misc_feature (643)..(643): n is a, c, g, or t
  modified_base (645)..(646): a, c, t, g, unknown or other
  misc_feature (645)..(646): n is a, c, g, or t
  modified_base (648)..(649): a, c, t, g, unknown or other
  misc_feature (648)..(649): n is a, c, g, or t
  modified_base (651)..(663): a, c, t, g, unknown or other
  misc_feature (651)..(663): n is a, c, g, or t
tcagcgtctagtaccacgaccggtgctcgatttagtagctctatcagggaagggacgtggaggtggagttggcgaatatgcatgacagtgggggcgaccgaactacaaccccctccctccaagacgtcgaattcaccttatcactagacgcgtccaagaagcagttacctccctgaagctgagctctgtgtaccgccgcagacacgggcccgcgtactttctgtgcggacgacccgggaggttaccggtttatacgtaggtaaaaacggttcgttacgttgctacgtattagtttcggtttagggttggtttttaggtactttggtcgttggggtaccggacgggggtacgtaagtcgggttcgtaacccgttcgttaccgttcgtacggtcccttccggaaccggtaccggggaccctacgtccggttcccttcccccggtcggtaccctaccccgttcccgtaccgaacggaaccgtcccaccgtccgggttacgggggcctaaaccgccgggccgtccccggtacgggtctacggccgtacgggtacgaaccggtccgtaccttccggtactacggtacgcgtagccggcggcgtcggacacgggtcgcgaacgnggtantgctgnaagcngttcnngtngnntnncnnnnnnnnnnnnn

SEQ ID NO: 151841 - DNA, 528 bp, Homo sapiens
  misc_feature: GYAE6OF01D77PN.14.74.G08.1.454.CMB.1.raw
  modified_base (501)..(528): a, c, t, g, unknown or other
  misc_feature (501)..(528): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgtttggttggttttgatggtcgtggggccgaggggacaagtggtcaccgttctcttcacgcctaccaccgaacgggccctagtccggtccttcccccgtggccctaccctcctaccaagcgccaccgtcggtcggggcacgacggccggcccgtcgggctcggccgtggtacgaacgggtaccttaccttccgtactagaccgtctggaggcgggcgtgggacgaacggcgcgtagtagnnnnnnnnnnnnnnnnnnnnnnnnnnnn

SEQ ID NO: 151842 - DNA, 558 bp, Homo sapiens
  misc_feature: GYAE6OF01CLJZ7.14.74.G08.1.454.CMB.1.raw
  modified_base (529)..(558): a, c, t, g, unknown or other
  misc_feature (529)..(558): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagacccgggagtacggttttactatagaaaaaggtcgttctgcacatattgttggttggttttgatgtcgtggggccaggggacaatggtcaccgtctctcagcctccaccaaggccagtccggtccttcccccgtggccacccctcctaccaagacgcctaccgtcgtgggggccaacgacggccggtaccccgtggggcctcggcccgttcgggtaccgtaacgggtaccttaacctttcccggtaaccgtaacggaccgcgttaggacggccggggtcgttacgggacgaaacggggccgacgtaagtaggcannnnnnnnnnnnnnnnnnnnnnnnnnnnnn

SEQ ID NO: 151843 - DNA, 825 bp, Homo sapiens
  misc_feature: GYAE6OF01E5JMD.14.74.G08.1.454.CMB.1.raw
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtcgacccgccgcacgacgaccggccgtcgttatttcgtgtcgacgacggacccgggtaggttacggttttactaagtaaggtaaaacggttcgttacgtcgctactattagtttggtttggttggttttagagttcggtcggtcggggaccgaacggggtaacgtaacgttcggtaccgtaccgttccgttcgttaccgtaccgtccccgtacccgaaccggaaccgggtaccctacgttcccggtttacccctttcccccgtacggtacccctacccccgtaccgtaccgaacgtaccgtaccctaccgttacggggtcggggtaccgaccggtaccgggccccgggtacccgggttcggggtacccgttaccgggtaccccggttacggggttaacccgtaaaccggggttaccctttaaccccgggtttacccggttaaaccgttaacggtacccgggtacgttaacggggacccggggtaccggggtaccggttaccggggaacggaaaccggggtcccgtaacgtaaccggtacgagacacggtacacgtggtacgacgtacgtacgtacgcgtacgacgtacgtacgtcgtacgtacgtacgtacggtcgacgtacgacgtacgtacgtagtcgtcgtcgtacg

SEQ ID NO: 151844 - DNA, 535 bp, Homo sapiens
  misc_feature: GYAE6OF01C201F.14.74.G08.1.454.CMB.1.raw
  modified_base (506)..(535): a, c, t, g, unknown or other
  misc_feature (506)..(535): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggttggttttgatgtcgtggggccgaggggacaagtggtcaccgtctcttcacgcctccaccgaagggcccagtccggttccttacccccgtggccacccctcctccgaaagcgcaccgtcgtgggggccacgacggccggcccgtgggctcgccgttggaccgaaggtaccttaccgttcccgtaacgtagaccgtgttcggaacggcgggtcgtcgggacaaagggccgacgaagtagcgnnnnnnnnnnnnnnnnnnnnnnnnnnnnnn

SEQ ID NO: 151845 - DNA, 554 bp, Homo sapiens
  misc_feature: GYAE6OF01EJPQM.14.74.G08.1.454.CMB.1.raw
  modified_base (521)..(521): a, c, t, g, unknown or other
  misc_feature (521)..(521): n is a, c, g, or t
  modified_base (524)..(531): a, c, t, g, unknown or other
  misc_feature (524)..(531): n is a, c, g, or t
  modified_base (533)..(554): a, c, t, g, unknown or other
  misc_feature (533)..(554): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgacgacccgggagtacggttttacatagaaaaaggtcgttctgacactatattgttggttggttttgatgtcgtggggccgaggggactaagtggtcaccgtctcttcacgccctccaccgacggcccacgtccggtcccttcccccgtggccacccctccctaccaacgacgccaccgtcggtcgggggaccacgacggccggcccgtgggctcggccgtgggtaccgaacggtaccttacctttcccggtaacgtacggtaccgtcgtggacggcgggtcgtcgggaccgtacgggccgacgagtagnacnnnnnnnngnnnnnnnnnnnnnnnnnnnnnn

SEQ ID NO: 151846 - DNA, 598 bp, Homo sapiens
  misc_feature: GYAE6OF01EC1NR.14.74.G08.1.454.CMB.1.raw
  modified_base (567)..(567): a, c, t, g, unknown or other
  misc_feature (567)..(567): n is a, c, g, or t
  modified_base (570)..(573): a, c, t, g, unknown or other
  misc_feature (570)..(573): n is a, c, g, or t
  modified_base (576)..(598): a, c, t, g, unknown or other
  misc_feature (576)..(598): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgaggacccgggagtacggttttactatagaaaaggtcgttctgcacatagttgttggttggttttgattgtcgtggggccgaggggacaagtggtccaccgttctctcgacgtccctaccaccgaacgggccctacgtccggttcccttcccccgtggccctaccccgtcctaccaacgacgtccaccgtcggtcgggggacacggacggcccggccgttcgggcctcggccgttacgggtaccgaaacgggttacctttaaccgtttacccggtaacgtacggaccggtcgtacgggaacgggtccggggtccgttacgggaccggaaacgggcccgtacgtaacgtaggcagcncgnnnngcnnnnnnnnnnnnnnnnnnnnnnn

SEQ ID NO: 151847 - DNA, 446 bp, Homo sapiens
  misc_feature: GYAE6OF01AX38S.14.74.G08.1.454.CMB.1.raw
  modified_base (222)..(222): a, c, t, g, unknown or other
  misc_feature (222)..(222): n is a, c, g, or t
  modified_base (435)..(446): a, c, t, g, unknown or other
  misc_feature (435)..(446): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccggganacggttttactaatgaaaaaggtcgttctgcacatattgttggtggttttgatgtctggggccaggggacaatggtcaccgtctcttcagctccaccaaggcccatcgtcttcccctggcaccctctccagagcactctggggcacacgcggcctgggctgcctgcaaggactactccgtactagcgctgagcgggctggcaaggcgcatagnnnnnnnnnnnn

SEQ ID NO: 151848 - DNA, 640 bp, Homo sapiens
  misc_feature: GYAE6OF01DVDI0.14.74.G08.1.454.CMB.1.raw
  modified_base (609)..(609): a, c, t, g, unknown or other
  misc_feature (609)..(609): n is a, c, g, or t
  modified_base (611)..(640): a, c, t, g, unknown or other
  misc_feature (611)..(640): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgacggacccggggagtacggttttaactataggaaaaaggtcgttctgcactatattggtttgggttggtttttagagttggtcgtcggggggtccgaagggggtaactaagtcggtcctacccggttccttcgtttccgacggtacccctacccgaacccgtaaacggggcccctaacgttccccgggttccctttccccccgcggtacccacccccttccctaacccaaggacctcccgacccttcgggcggggtcaaccgacggtcccggcccggtcgggtcctcgcccggttgggtaccgaaacggtaccgttaccgttaccggtaccgtaacggtacggtccgtagggcgggacgggtccgtcgggtaccggaaggaccggcctaaggtacgngnnnnnnnnnnnnnnnnnnnnnnnnnnnnnn

SEQ ID NO: 151849 - DNA, 559 bp, Homo sapiens
  misc_feature: GYAE6OF01DYSY4.14.74.G08.1.454.CMB.1.raw
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (532)..(559): a, c, t, g, unknown or other
  misc_feature (532)..(559): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacaccggccgcgtatttctgtgcgagaccggagacggttttacatgaaaaagtcgttctgacactattattggttggttggtttttcgagttggtcgttggggaccgtaaggggacaagttcggtcctaccggtcttcctttcgacgttccctacccgaaccgaaacgggcccaagttccggtccctttccccctggccctaccccgtacctccaaagccgtcaccctcgtcggggccacgacggccggtcccgtgggcctcggccctaggttacaagggtccttacgtccggtactaggaccgtctaggacggcgggacctggaccgaaggccgnaagtgncnnnnnnnnnnnnnnnnnnnnnnnnnnnn

SEQ ID NO: 151850 - DNA, 504 bp, Homo sapiens
  misc_feature: GYAE6OF01AWWS8.14.74.G08.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
  modified_base (478)..(504): a, c, t, g, unknown or other
  misc_feature (478)..(504): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccncgtatttctgtgcgagacccgggagacggttttactatagaaaaaggtcgttctgcacatattgttggtggttttgatgtctggggccaggggacaagtggtcacgtctcttnacgcctccaccaacgggcccagtccggtcctttcccccggcgacccctccctccaacgagcacctcgtcgggcgaccacgccggcccgtcggcgtcgcgtcgtcgacgacgtacttccctactagacgccgttgacggtcggacgcggagaacggcgccttagagcgnnnnnnnnnnnnnnnnnnnnnnnnnnn

SEQ ID NO: 151851 - DNA, 545 bp, Homo sapiens
  misc_feature: GYAE6OF01A3W9V.14.74.G08.1.454.CMB.1.raw
  modified_base (295)..(295): a, c, t, g, unknown or other
  misc_feature (295)..(295): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (524)..(545): a, c, t, g, unknown or other
  misc_feature (524)..(545): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacgggttttactagtagaaaaaggtcgttctgcacatattgttggtggtttttgatgtctggggccagggganaatggtcaccgtctcttcagtccctccaccgagggccctagtccggtaccttccccctggccacccctcctccaagcgctacccgtcgtcgggggcacgacggcggcccgtgggctggcctcgggtacgaacgggtactaccgttcccgtactaggaccgtcgtacggacggtaccgggtcgtacgggaccgaaacggggccgactaagtggcatgngctangcancgnnnnnnnnnnnnnnnnnnnnnn

SEQ ID NO: 151852 - DNA, 567 bp, Homo sapiens
  misc_feature: GYAE6OF01C0EL9.14.74.G08.1.454.CMB.1.raw
  modified_base (257)..(257): a, c, t, g, unknown or other
  misc_feature (257)..(257): n is a, c, g, or t
  modified_base (542)..(567): a, c, t, g, unknown or other
  misc_feature (542)..(567): n is a, c, g, or t
tcagcgtctagtaccacgaccggtgctcgatttagtagctctatcagggaagggactggagtggattggcaatatgcatgacagtgggggcaccaaactacaaccccctccctcaagatcgagtcaccttatcactagacgcgtccaagaagcagttctccctgaagctgagctctgtgaccgccgcagacgacggccgcgttatttctgtgcgacgaccgggagtacggttttacatagaaaagtcgttctgcacntattgttggttggtttgatgtcgtgggccgaggggacaagtcggtcaccgtcttcgtaccacgccctaccgaaccgaacggccctagtcccgttcccttccccgtcgcccacccctcctccgaagacgaccctaccgtcgggtacggggccacgacggccccggtacccgtcgggtcctcggcccgttacgggtacctaacggggtacctttaacccgtttccccggtaacgtaccggacgtcgtgggacgggtccgggcgtacggacgaggccgatacgtacgnnnnnnnnnnnnnnnnnnnnnnnnnn

SEQ ID NO: 151853 - DNA, 720 bp, Homo sapiens
  misc_feature: GYAE6OF01AK75Z.14.74.G08.1.454.CMB.1.raw
  modified_base (672)..(672): a, c, t, g, unknown or other
  misc_feature (672)..(672): n is a, c, g, or t
  modified_base (678)..(678): a, c, t, g, unknown or other
  misc_feature (678)..(678): n is a, c, g, or t
  modified_base (687)..(687): a, c, t, g, unknown or other
  misc_feature (687)..(687): n is a, c, g, or t
  modified_base (696)..(696): a, c, t, g, unknown or other
  misc_feature (696)..(696): n is a, c, g, or t
  modified_base (700)..(700): a, c, t, g, unknown or other
  misc_feature (700)..(700): n is a, c, g, or t
  modified_base (702)..(704): a, c, t, g, unknown or other
  misc_feature (702)..(704): n is a, c, g, or t
  modified_base (706)..(706): a, c, t, g, unknown or other
  misc_feature (706)..(706): n is a, c, g, or t
  modified_base (708)..(710): a, c, t, g, unknown or other
  misc_feature (708)..(710): n is a, c, g, or t
  modified_base (712)..(720): a, c, t, g, unknown or other
  misc_feature (712)..(720): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgacggacccggggtagtacggttttactatagaaaaacggttcgttctgaccactattatttggtttgggttggtttttgagttgttcggtgggggaccgaggggacaagttcggtccacccgttcttctttcaacgtccctccaaccggaacgggcccctaggtttcccggttacccctttccccccgtcgggtaccccctacccccgttacccgttacccgaaacggtaccggtacccgaaccccgtttcggggtaccggggggaccaaccgggacccgggtcccgggttacccccggtcgggggtcccttccgggtccccggttacgggttaacccggtaaaccggggttaccctttaacccggtttacccggttaacgtacgggtaacccgtcgtaggggaaccggtccggggtacgttaccggggaccgggtaaacgggtccgaacgtaagtcggntacgtncgctagcgnacagttcgnagcngnnngntnnncnnnnnnnnn

SEQ ID NO: 151854 - DNA, 541 bp, Homo sapiens
  misc_feature: GYAE6OF01B37U5.14.74.G08.1.454.CMB.1.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (511)..(511): a, c, t, g, unknown or other
  misc_feature (511)..(511): n is a, c, g, or t
  modified_base (513)..(514): a, c, t, g, unknown or other
  misc_feature (513)..(514): n is a, c, g, or t
  modified_base (516)..(541): a, c, t, g, unknown or other
  misc_feature (516)..(541): n is a, c, g, or t
tcagcgtctagtaccacgaccggtgctcgatttagtagctctatcagggaagggactggagtggattggcaatatgcatgacaggtggggcaccaactacaaccccctccctcaagagtcgagtcaccttatcactagacgcgtccaagaagcagttctccctgaagctgagctctgtgacccgccgcaacgaccgacggccgtcgttatttcgtgtgcgaggaccgggagtacggtttanagtagaaaagtcttngcactattagttgttggttggtttgagtgtcgngggcgaggganagtgcncgtctctcncgcctccaccacgggcctacgtccggtcccttccccgtcgaccctaccctccctaccaagaccgctacccgtgggcgggacacgacggccggccgtggctcgcgtcgtacgaacggtcctacgttaccgaacgtacgtacggtcgtacggacgggccgggtacgtcgggaaccgaacgggtaccgacgtaatacgncnngnnnnnnnnnnnnnnnnnnnnnnnnnn

SEQ ID NO: 151855 - DNA, 556 bp, Homo sapiens
  misc_feature: GYAE6OF01BQCOA.14.74.G08.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
  modified_base (540)..(556): a, c, t, g, unknown or other
  misc_feature (540)..(556): n is a, c, g, or t
tcagcgtctagtaccacgaccggtgctcgatttagtagctctatcagggagggactggagtggattggcaatatgcatgacgaggtggggcaccaactacaacccctccctcaagagtcgagtcaccttatccacgtacgacggcgtaccaagtaaagcaggtttcctccctagaacggctgagctccgtgtcgacccggccncagaaccncggccgnttattcngtgcgacggacggagtacgtttacaatagaaagtcgttngcactattgttggtgttcgtttgactgtggnggggaccagggtacatcggctaacgttctacttcgcgtccacgacgaccggtacacgtcgtcccttccgngaccncctacgtacctgaanccgacgtcgcgggacacggcgtccgacgtcggctccgaggtcgaacgaacgtaccctacggtttaccacctagggcctaacggngtacgggccggtaggtcgggacgaacgtccggaangacgcaggnacgcttagccaagccttgcgcaangcnnnnnnnnnnnnnnnnn

SEQ ID NO: 151856 - DNA, 688 bp, Homo sapiens
  misc_feature: GYAE6OF01DG0P7.14.74.G08.1.454.CMB.1.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (650)..(650): a, c, t, g, unknown or other
  misc_feature (650)..(650): n is a, c, g, or t
  modified_base (659)..(659): a, c, t, g, unknown or other
  misc_feature (659)..(659): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (670)..(671): a, c, t, g, unknown or other
  misc_feature (670)..(671): n is a, c, g, or t
  modified_base (674)..(675): a, c, t, g, unknown or other
  misc_feature (674)..(675): n is a, c, g, or t
  modified_base (677)..(678): a, c, t, g, unknown or other
  misc_feature (677)..(678): n is a, c, g, or t
  modified_base (681)..(686): a, c, t, g, unknown or other
  misc_feature (681)..(686): n is a, c, g, or t
  modified_base (688)..(688): a, c, t, g, unknown or other
  misc_feature (688)..(688): n is a, c, g, or t
tcagcgtctagtaccacgaccggtgctcgattttagtagctctatcagggaagggactggagtggattggcaatatgcatgacaggtggggcaccaactacaaccccctccctcaagatcgagtcaccttatcactagacgcgtaccaagaagacagttacctacccccgaaagtctgagcctcttgtcgacccgccgcgaacgacaaccgggccgacgttatttcgtaggtcgcgaacggacccgggacgtacggtttttaactagtaagaaaacggttctctgacanattagttggttggttcggtttanagtggtcggtcgggaccggaagggactaagtcggtcaccgttcttactcgacgcctaccgaccgaaggccctagttccgtcccttccccgaccggacctaccccctactaaccgaagtacccgacgttaccgtcgggtacggggacctaaccggcgggtccccggtaccggtccgggggtccttaccggggtacccggttaaggtaaacccggaaacgggtttccgtttaacccgtttaacccgttaaccggtaacggttaccgtacgtacgggaacgggttcccggaggttaacgggacgaacggtaccgtaacgagtacgtnacgngnngangngngtacgacangacgcgngnanntanncnnacnnnnnngn

SEQ ID NO: 151857 - DNA, 660 bp, Homo sapiens
  misc_feature: GYAE6OF01CUF9P.14.74.G08.1.454.CMB.1.raw
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (640)..(640): a, c, t, g, unknown or other
  misc_feature (640)..(640): n is a, c, g, or t
  modified_base (642)..(651): a, c, t, g, unknown or other
  misc_feature (642)..(651): n is a, c, g, or t
  modified_base (653)..(653): a, c, t, g, unknown or other
  misc_feature (653)..(653): n is a, c, g, or t
  modified_base (655)..(660): a, c, t, g, unknown or other
  misc_feature (655)..(660): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagaccgacggcccgtcgtattctgtgcgacgaccgggagtacggttttatagtagaaaacggtcttatgcactatagttgttggttggtttgtagtgtcgcgggaccgagggacagtcgtcctaccgtctcgttcacgtccctaccgtacgacggtcccgagttcccggttccccgttccccgtcggacccctacccccgtcccttaccgaaacgtcccgtaccgtacccggttcgggaccggggaccgaacgtccgggtccggtacccgggtcgggtaccgttccggtaccgttacgggtaaccgtaaccgggttacgtttaaccccgtttcccgggttaaaccgtaacgcccgggttaggtacgggaccgggtacccgggttacgaccggggtaacggtaacgggtccggaacgtagtcggacgatcanccgnaccgtgctgatcaagtcncnnnnnnnnnncncnnnnnn

SEQ ID NO: 151858 - DNA, 576 bp, Homo sapiens
  misc_feature: GYAE6OF01DGLS6.14.74.G08.1.454.CMB.1.raw
  modified_base (176)..(176): a, c, t, g, unknown or other
  misc_feature (176)..(176): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
  modified_base (436)..(436): a, c, t, g, unknown or other
  misc_feature (436)..(436): n is a, c, g, or t
  modified_base (500)..(500): a, c, t, g, unknown or other
  misc_feature (500)..(500): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (551)..(576): a, c, t, g, unknown or other
  misc_feature (551)..(576): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgagctgaagctctgngaccgccgacagacacggcccgtcgtatttcgtgtgcgacgacccgggagtacgtttacatagaaaaggtcgtntgcacgatagttgttggttgttttgatcgtagtgggccgaggggacaagtcggtaccaccggttctcttacgntaccgtaccaaccgaggccctagtcccgtcctttaccccgnggccctaccctcctcgaaacgacgttccaacccgtcgggcgggacgtaaccgacggacccgggtttacccgngggtccgtcgccggtttacgacgtaaaccgtaccggttactttacccggaaccgtagaccccgngtggacggacggggtnttcgggaatacgnggtaccaggtgntagngcagcnnnnnnnnnnnnnnnnnnnnnnnnnn

SEQ ID NO: 151859 - DNA, 733 bp, Homo sapiens
  misc_feature: GYAE6OF01DAKMJ.14.74.G08.1.454.CMB.1.raw
  modified_base (220)..(220): a, c, t, g, unknown or other
  misc_feature (220)..(220): n is a, c, g, or t
  modified_base (692)..(692): a, c, t, g, unknown or other
  misc_feature (692)..(692): n is a, c, g, or t
  modified_base (697)..(697): a, c, t, g, unknown or other
  misc_feature (697)..(697): n is a, c, g, or t
  modified_base (707)..(710): a, c, t, g, unknown or other
  misc_feature (707)..(710): n is a, c, g, or t
  modified_base (712)..(718): a, c, t, g, unknown or other
  misc_feature (712)..(718): n is a, c, g, or t
  modified_base (720)..(733): a, c, t, g, unknown or other
  misc_feature (720)..(733): n is a, c, g, or t
tcagcgtctagtaccacgaccggtgctcgatttagtagctctatcagggaagggactggagtggattggcaatatgcatgacaggtgggggcaccaaactacaacccccctccctacaagagtcgagtcaccttatcactagacgcgtccaagaagcacgttcctccctgaatctgagtctcgtgtcgaccgccgacgacgaccgaccggccgtacgttntttcgtggtcggacgaacgggacccggggtaagtttaaccgggtttttaactaagttaaacgggtaaaaacggttccgtttacgtacggactaacgtatttagttttgggttttgggttttggtttcgttggttcggttcgggtacgggtacccgggaaggggtaaccgtaggttcggacctaccggttcctttaccgtcccgtacgtccccgtaccgaaccggtaccggtcccgttacgtccccgttaccccgtttccccgaccgtccccgtacccctccgtaccgaacgtccgtaaccgtccggttcggggccggtacacggcccggcccgtcggtccgggtactccggtcggttacggccggtaaggtcccgttacgtccgttttaaccccggacgtaaaccgggtccgttacggacggggtaccgggggtacccggtagggaccggaacggtaccggacgtacgtaanccgancgcttgcagnnnngnnnnnnngnnnnnnnnnnnnnn

SEQ ID NO: 151860 - DNA, 451 bp, Homo sapiens
  misc_feature: GYAE6OF02GHHGT.14.74.G08.1.454.CMB.1.raw
  modified_base (445)..(451): a, c, t, g, unknown or other
  misc_feature (445)..(451): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnn

SEQ ID NO: 151861 - DNA, 456 bp, Homo sapiens
  misc_feature: GYAE6OF02GJ69Y.14.74.G08.1.454.CMB.1.raw
  modified_base (445)..(456): a, c, t, g, unknown or other
  misc_feature (445)..(456): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggccctgggctgcctggtcaggacacttctgtactagacgctgagcgggctggcaaggcgcatagnnnnnnnnnnnn

SEQ ID NO: 151862 - DNA, 451 bp, Homo sapiens
  misc_feature: GYAE6OF02JC209.14.74.G08.1.454.CMB.1.raw
  modified_base (445)..(451): a, c, t, g, unknown or other
  misc_feature (445)..(451): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggctacttccgtactagacgctgagcgggctggcaaggcgcatagnnnnnnn

SEQ ID NO: 151863 - DNA, 376 bp, Homo sapiens
  misc_feature: GYAE6OF02HLPPR.14.74.G08.1.454.CMB.1.raw
  modified_base (372)..(376): a, c, t, g, unknown or other
  misc_feature (372)..(376): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtctagacgctgagcgggctggcaaggcgcatagnnnnn

SEQ ID NO: 151864 - DNA, 379 bp, Homo sapiens
  misc_feature: GYAE6OF02GRHAP.14.74.G08.1.454.CMB.1.raw
  modified_base (373)..(379): a, c, t, g, unknown or other
  misc_feature (373)..(379): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnn

SEQ ID NO: 151865 - DNA, 452 bp, Homo sapiens
  misc_feature: GYAE6OF02HQQPP.14.74.G08.1.454.CMB.1.raw
  modified_base (446)..(452): a, c, t, g, unknown or other
  misc_feature (446)..(452): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggcctgggctgcctggtcaaggactacttccgtactagacgctgagcgggctggcaaggcgcatagnnnnnnn

SEQ ID NO: 151866 - DNA, 451 bp, Homo sapiens
  misc_feature: GYAE6OF02HIZXT.14.74.G08.1.454.CMB.1.raw
  modified_base (443)..(451): a, c, t, g, unknown or other
  misc_feature (443)..(451): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcactctggggcacagcggcctgggctgcctggtcaaggactacttcgtactagacgctgagcgggctggcaaggcgcatagnnnnnnnnn

SEQ ID NO: 151867 - DNA, 451 bp, Homo sapiens
  misc_feature: GYAE6OF02GEYKS.14.74.G08.1.454.CMB.1.raw
  modified_base (446)..(451): a, c, t, g, unknown or other
  misc_feature (446)..(451): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggccctgggctgcctggtcaaggactactccgtactagacgctgagcgggctggcaaggcgcatagnnnnnn

SEQ ID NO: 151868 - DNA, 450 bp, Homo sapiens
  misc_feature: GYAE6OF02HNF4U.14.74.G08.1.454.CMB.1.raw
  modified_base (444)..(450): a, c, t, g, unknown or other
  misc_feature (444)..(450): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaaggcccatcggtcttcccctggcaccctcctccagagcacctctgggggcacgagcggccctgggctgcctggtcaaggactacttccgtactagacgctgagcgggctggcaaggcgcatagnnnnnnn

SEQ ID NO: 151869 - DNA, 452 bp, Homo sapiens
  misc_feature: GYAE6OF02IBK90.14.74.G08.1.454.CMB.1.raw
  modified_base (304)..(304): a, c, t, g, unknown or other
  misc_feature (304)..(304): n is a, c, g, or t
  modified_base (446)..(452): a, c, t, g, unknown or other
  misc_feature (446)..(452): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtntcttcagcctccaccaagggcccatcggtcttcccctggccaccctcctccaagagccacctctgggggcacagcggccctggctgcctggtcaaggactacttccgtactagacgctgagcgggctggcaaggcgcatagnnnnnnn

SEQ ID NO: 151870 - DNA, 449 bp, Homo sapiens
  misc_feature: GYAE6OF02GO8CA.14.74.G08.1.454.CMB.1.raw
  modified_base (445)..(449): a, c, t, g, unknown or other
  misc_feature (445)..(449): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcatagnnnnn

SEQ ID NO: 151871 - DNA, 456 bp, Homo sapiens
  misc_feature: GYAE6OF02F98XF.14.74.G08.1.454.CMB.1.raw
  modified_base (448)..(456): a, c, t, g, unknown or other
  misc_feature (448)..(456): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagaccccgggagacggttttactatgaaaaaggtcgttctgcacatattgttggtggttttgatgtctggggccaggggacaatggtcaccgtctcttcagcctccaccaagggcccatcggtcttccccctggcacccctcctccaagacgcacctctgggggcacagcggccctgggctgcctggtcaaggactactccgtactagacgctgagcgggctggcaaggcgcatagnnnnnnnnn

SEQ ID NO: 151872 - DNA, 459 bp, Homo sapiens
  misc_feature: GYAE6OF02IZ4GW.14.74.G08.1.454.CMB.1.raw
  modified_base (442)..(456): a, c, t, g, unknown or other
  misc_feature (442)..(456): n is a, c, g, or t
  modified_base (459)..(459): a, c, t, g, unknown or other
  misc_feature (459)..(459): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggcaatggtcaccgtctcttcagcctccaccaagggcccatcggtcttccccctggcaccctcctccaagagcacctctgggggcacagcggccctgggctgcctggtcaaggctacttccgactagacgctgagcgggctggcaaggcgcatagnnnnnnnnnnnnnnnggn

SEQ ID NO: 151873 - DNA, 456 bp, Homo sapiens
  misc_feature: GYAE6OF02F1JTV.14.74.G08.1.454.CMB.1.raw
  modified_base (448)..(456): a, c, t, g, unknown or other
  misc_feature (448)..(456): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggcaccctcctccaagagcacctctgggggcacagcggccctgggctgcctgggtcaaggactacttccgtactagacgctgagcgggctggcaaggcgcatagnnnnnnnnn

SEQ ID NO: 151874 - DNA, 461 bp, Homo sapiens
  misc_feature: GYAE6OF02F6LSM.14.74.G08.1.454.CMB.1.raw
  modified_base (452)..(461): a, c, t, g, unknown or other
  misc_feature (452)..(461): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgtatgtctggggccagggggacaatggtcaccgtctcttcagcctccaccaagggcccatcggtcttccccctggccacccctcctccaagacgcacctctcgggggcacagcggccctgggctgcctggtcaggactacttccgtactagacgctgagcgggctggcgaaggcgcatagnnnnnnnnnn

SEQ ID NO: 151875 - DNA, 450 bp, Homo sapiens
  misc_feature: GYAE6OF02I6UJC.14.74.G08.1.454.CMB.1.raw
  modified_base (443)..(450): a, c, t, g, unknown or other
  misc_feature (443)..(450): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccagggccatcgtcttcccctggcaccctcctccaagacgcacctctggggcacgagcggccctggctgcctggtcaaggactactccgtactagacgctgacgcgggctggcaaggcgcatagnnnnnnnn

SEQ ID NO: 151876 - DNA, 377 bp, Homo sapiens
  misc_feature: GYAE6OF02GWMNS.14.74.G08.1.454.CMB.1.raw
  modified_base (373)..(377): a, c, t, g, unknown or other
  misc_feature (373)..(377): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnn

SEQ ID NO: 151877 - DNA, 453 bp, Homo sapiens
  misc_feature: GYAE6OF02JEEHX.14.74.G08.1.454.CMB.1.raw
  modified_base (441)..(453): a, c, t, g, unknown or other
  misc_feature (441)..(453): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggccatcggtcttcccctggcaccctcctccagagcacctctggggcacagcggcctgggctgcctggtcaaggactacttccgtatacgacgctgagcgggctggcaggcgcatagnnnnnnnnnnnnn

SEQ ID NO: 151878 - DNA, 446 bp, Homo sapiens
  misc_feature: GYAE6OF02IT00U.14.74.G08.1.454.CMB.1.raw
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
  modified_base (438)..(446): a, c, t, g, unknown or other
  misc_feature (438)..(446): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaaggtcgttctgcacatattgttgtggtttgatgtctgggccaggggacaatggtcaccgtctcttcagcctccaccaagggcccatcggtcttcccctgcaccctctccaagngcacctctgggggcacagcggcctggctgcctggtcaaggactactccgtactagacgntgagcgggctggcaaggcgcatagnnnnnnnnn

SEQ ID NO: 151879 - DNA, 490 bp, Homo sapiens
  misc_feature: GYAE6OF02JEGDH.14.74.G08.1.454.CMB.1.raw
  modified_base (463)..(464): a, c, t, g, unknown or other
  misc_feature (463)..(464): n is a, c, g, or t
  modified_base (466)..(490): a, c, t, g, unknown or other
  misc_feature (466)..(490): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaagtggtcaccgtctcttcagcctccaccaagggcccatccggtccttcccctggccacccctcctccaagacgccacctcgtcgggggcacgacgccggccctgggctcgccgtggtcaaggactacgttccgtactacgacgctgacgcgggctggacaaggcgcatagnngnnnnnnnnnnnnnnnnnnnnnnnnn

SEQ ID NO: 151880 - DNA, 461 bp, Homo sapiens
  misc_feature: GYAE6OF02G3HU6.14.74.G08.1.454.CMB.1.raw
  modified_base (453)..(461): a, c, t, g, unknown or other
  misc_feature (453)..(461): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccagggggacaagtggtcaccgtctcttcagcctccaccaaggcccatcggtcttcccctggccaccctcctccaagacgccacctcgtgggggcacgagccggccctgggctgcctggtcaaggactacttccgtactagacgctgagcgggctggcaaggcgcatagnnnnnnnnn

SEQ ID NO: 151881 - DNA, 670 bp, Homo sapiens
  misc_feature: GYAE6OF02I27U0.14.74.G08.1.454.CMB.1.raw
  modified_base (343)..(343): a, c, t, g, unknown or other
  misc_feature (343)..(343): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(670): a, c, t, g, unknown or other
  misc_feature (641)..(670): n is a, c, g, or t
tcagcgtctagtaccacgaccggtgctcgatttagtagctctatcagggaagggactggagtggattggcaatatgcatgacagtgggggcaccaactacaacccctccctcaagagtcggacgtctaccttatcagtacgacgtccgtaccaaagacgactacgttccctcccgtagaacgtcgtgacgcttcgtggtccggacccggcccgacgaacgaaccggccggcccggtacgtttatttcgtggtcgacggaccgggaccgggacggtttacggtttaactagtaaagtaaaacggttcgtcgtgccaatagttagtttggttgggtttggtttanagttcgttcgggtcgggacggacgggaataggtcgtccgtaccgtccttctacgaccgtcctaccgaaccggaccggacctacggttccggttccccttccccggcgacccctacccctccgtaaccgaacgacgaccctaccgtcgggacggggacctaacgcggcccggtcccgggtcggccgtcggtaccggtcggtaacggaaccgtaccgtttaacccgtttacccgtaagtaaccggacgtccgtagggaccggggccggtcgtcggaacggacggcctacgtaagngcngnnnnnnnnnnnnnnnnnnnnnnnnnnnnnn

SEQ ID NO: 151882 - DNA, 380 bp, Homo sapiens
  misc_feature: GYAE6OF02GSBMO.14.74.G08.1.454.CMB.1.raw
  modified_base (374)..(380): a, c, t, g, unknown or other
  misc_feature (374)..(380): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggacctacttccgtactagacgctgagcgggctggcaaggcgcatagnnnnnnn

SEQ ID NO: 151883 - DNA, 464 bp, Homo sapiens
  misc_feature: GYAE6OF02G380E.14.74.G08.1.454.CMB.1.raw
  modified_base (454)..(464): a, c, t, g, unknown or other
  misc_feature (454)..(464): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtccttccccctggccacccctcctccaacgacgccacctctcgggggcacgagcggccctgggctgcctggtcaaggactacttccgtactagacgctgagcgggctggcaaggcgcatagnnnnnnnnnnn

SEQ ID NO: 151884 - DNA, 512 bp, Homo sapiens
  misc_feature: GYAE6OF02HHP0X.14.74.G08.1.454.CMB.1.raw
  modified_base (501)..(512): a, c, t, g, unknown or other
  misc_feature (501)..(512): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggttggttttgatgtcgtggggccgaggggacaagtggtcaccgtctcttcagcctccaccgaacggcccatccggtccttccccctggccacccctcctaccaagacgcctaccgtcgtcgggggccacgacggccggcccgtgggcctcggcccgttgggtccaagggtacctaccgtttacccggtactaacggaccgcgtgacggccgggcgtgggcgaacgggcgcgagtagnnnnnnnnnnnn

SEQ ID NO: 151885 - DNA, 412 bp, Homo sapiens
  misc_feature: GYAE6OF02JXL15.14.74.G08.1.454.CMB.1.raw
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (386)..(388): a, c, t, g, unknown or other
  misc_feature (386)..(388): n is a, c, g, or t
  modified_base (390)..(390): a, c, t, g, unknown or other
  misc_feature (390)..(390): n is a, c, g, or t
  modified_base (396)..(397): a, c, t, g, unknown or other
  misc_feature (396)..(397): n is a, c, g, or t
  modified_base (399)..(412): a, c, t, g, unknown or other
  misc_feature (399)..(412): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttcctgtgcgagacccgggagacggttttactatgaaaaaggtcgttctgcacatatgttggtgtttgatgtctggggccaggggacaatggtcaccgtntcttcagcctccacaagggcccatcggtcttcccccnggccaccctcctccaagagccacctctggggcacacgcggccctgggcctgaccctggtaccaaggacctacgttcccgtactagaccgctggagccgggctggctaaggcgcagtaggnnngncgatcnnannnnnnnnnnnnnn

SEQ ID NO: 151886 - DNA, 495 bp, Homo sapiens
  misc_feature: GYAE6OF02GE4AA.14.74.G08.1.454.CMB.1.raw
  modified_base (343)..(343): a, c, t, g, unknown or other
  misc_feature (343)..(343): n is a, c, g, or t
  modified_base (471)..(495): a, c, t, g, unknown or other
  misc_feature (471)..(495): n is a, c, g, or t
tcagcgtctagtaccacgaccggtgctcgatttagtagctctatcagggaagggactggagtggattggcaatatgcatgacagtgggggcaccaactacaaaccccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggtttgatgtcgtggggccaggggacaatggtcaccgtctcttcagcctccaccaagggcccatcgtcttcccccngccaccctcctccaagagcacctcgtgggggcacgacgccggcccgtgggctcggcccgtggtacaaggtacctaccgttccgtaactaggaccgctgaggccgggctgggacaacggcgacagtagnnnnnnnnnnnnnnnnnnnnnnnnn

SEQ ID NO: 151887 - DNA, 531 bp, Homo sapiens
  misc_feature: GYAE6OF02IFHKN.14.74.G08.1.454.CMB.1.raw
  modified_base (506)..(531): a, c, t, g, unknown or other
  misc_feature (506)..(531): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatagaaaaaggtcgttctgcacatattgttggtggttttgatgtctggggccaggggacaagtggtcaccgtctcttcagcctccaccaagggcccatccggtccttccccctggccacccctcctaccaagacgccacctcgcgggggcacgagccggtcccgtgggcctcggcccgtcgggtcaaaggtaccttaaccgtttcccggtaacttacggaccgcttacggacggccggggcgtacgggaccgaaagggccgacgaacgtaggnnnnnnnnnnnnnnnnnnnnnnnnnn

SEQ ID NO: 151888 - DNA, 510 bp, Homo sapiens
  misc_feature: GYAE6OF02JGHIT.14.74.G08.1.454.CMB.1.raw
  modified_base (102)..(102): a, c, t, g, unknown or other
  misc_feature (102)..(102): n is a, c, g, or t
  modified_base (142)..(142): a, c, t, g, unknown or other
  misc_feature (142)..(142): n is a, c, g, or t
  modified_base (162)..(162): a, c, t, g, unknown or other
  misc_feature (162)..(162): n is a, c, g, or t
  modified_base (347)..(347): a, c, t, g, unknown or other
  misc_feature (347)..(347): n is a, c, g, or t
  modified_base (447)..(447): a, c, t, g, unknown or other
  misc_feature (447)..(447): n is a, c, g, or t
  modified_base (482)..(482): a, c, t, g, unknown or other
  misc_feature (482)..(482): n is a, c, g, or t
  modified_base (485)..(510): a, c, t, g, unknown or other
  misc_feature (485)..(510): n is a, c, g, or t
tcagcgtctagtaccacgaccggtgctcgatttagtagctctatcagggaagggactggagtggattggcaatatgcatgacagtggggggcgaccaactanaaccccctccctccaacgagtcgagtcaccttatcactanacgcgtccaagaagcagttntccctgaagctgagctctgtgaccgccgcagacacggccgcgtatttctgtgcgagaccgggagacggtttactatgaaaaggtcgttctgcacatattgtggtggttttgatgtctggggccaggggtacaagtggtcaccggtctcgttcagcctccacgacgggccatccggtcttcccccnggccaccctcctccaagacgccacctcgtcgggggcacgacgcggccctgggcctcggccctgggtacaacgggctacctccggtactacggaccgtcgngacggccgggctgggactaagggccgcagtagcancgnnnnnnnnnnnnnnnnnnnnnnnnnn

SEQ ID NO: 151889 - DNA, 457 bp, Homo sapiens
  misc_feature: GYAE6OF02G1XFC.14.74.G08.1.454.CMB.1.raw
  modified_base (346)..(346): a, c, t, g, unknown or other
  misc_feature (346)..(346): n is a, c, g, or t
  modified_base (447)..(447): a, c, t, g, unknown or other
  misc_feature (447)..(447): n is a, c, g, or t
  modified_base (452)..(457): a, c, t, g, unknown or other
  misc_feature (452)..(457): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaagtggtcaccggtctcttcagcctccaccaagggcccagtcggtccttccccnggccaccctcctccaagagccacctctgggggcacagccggccctgggctgcctggtcaaggactacttccgtactagacgctgagcgggctggcaaggcncatgnnnnnn

SEQ ID NO: 151890 - DNA, 466 bp, Homo sapiens
  misc_feature: GYAE6OF02GJ868.14.74.G08.1.454.CMB.1.raw
  modified_base (453)..(466): a, c, t, g, unknown or other
  misc_feature (453)..(466): n is a, c, g, or t
tcagcgtctagtaccacgaccggtgctcgatttagtagctctatcagggaagggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggccaccctcctccaagacgcacctctgggggcacgacgcggccctggggctgcctgggtcaaggactactccgtactagacgctgagcgggctggcaaggcgcatagnnnnnnnnnnnnnn

SEQ ID NO: 151891 - DNA, 496 bp, Homo sapiens
  misc_feature: GYAE6OF02GTONR.14.74.G08.1.454.CMB.1.raw
  modified_base (469)..(469): a, c, t, g, unknown or other
  misc_feature (469)..(469): n is a, c, g, or t
  modified_base (477)..(496): a, c, t, g, unknown or other
  misc_feature (477)..(496): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccagggggacaagtggtcaccgtctcttcagcctccaccgaacgggcccatccggtccttccccctgggccacccctcctccaagacgccacctcgtcgggggcacacggccggccctgggcctgccgtggtacgaacgggtacctacgttccgtactacgacgctgacgcgggctggcgaaggcncgatagcnnnnnnnnnnnnnnnnnnnn

SEQ ID NO: 151892 - DNA, 466 bp, Homo sapiens
  misc_feature: GYAE6OF02I3VJD.14.74.G08.1.454.CMB.1.raw
  modified_base (457)..(466): a, c, t, g, unknown or other
  misc_feature (457)..(466): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccagtccggtcttccccctggccacccctcctccaagacgcacctcgtgggggccacagccggccctgggctgccgtggtcaaggactacgttccgtactacgcgctggacgcgggctggcaaggcgcatgnnnnnnnnnn

SEQ ID NO: 151893 - DNA, 521 bp, Homo sapiens
  misc_feature: GYAE6OF02I73O2.14.74.G08.1.454.CMB.1.raw
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (487)..(488): a, c, t, g, unknown or other
  misc_feature (487)..(488): n is a, c, g, or t
  modified_base (491)..(493): a, c, t, g, unknown or other
  misc_feature (491)..(493): n is a, c, g, or t
  modified_base (495)..(496): a, c, t, g, unknown or other
  misc_feature (495)..(496): n is a, c, g, or t
  modified_base (498)..(521): a, c, t, g, unknown or other
  misc_feature (498)..(521): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttgtgtttnatgtntgggccagggacatggtcaccgtctcttcagcctccaccgaagggcccatccggtcttccccctggccaccctcctccaagcgcacctcgtggggccacgacggccggcccgtgggcctcgccgtgggtacgaacgggaccttacctttacccggtaacgtacggacgtctaggacggccggggcctacgggcgaacgggccgacaagtagcnncgnnngnngnnnnnnnnnnnnnnnnnnnnnnnn

SEQ ID NO: 151894 - DNA, 556 bp, Homo sapiens
  misc_feature: GYAE6OF02FLAOB.14.74.G08.1.454.CMB.1.raw
  modified_base (528)..(556): a, c, t, g, unknown or other
  misc_feature (528)..(556): n is a, c, g, or t
tcagcgtctagtaccacgaccggtgctcgatttagtagctctatcagggaagggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggccacccctcctccaagacgccacctcgtcggggggccacgacggccggccccgtggggcctcggcccgttgggtccgaaacgggtaccttaaccgtttcccggttaaccgtaacggtaacccggccttgggaacgggccgggggtacgtcggggaccgaaaggggccgaccgaagtaacggnnnnnnnnnnnnnnnnnnnnnnnnnnnnn

SEQ ID NO: 151895 - DNA, 551 bp, Homo sapiens
  misc_feature: GYAE6OF02HS5EW.14.74.G08.1.454.CMB.1.raw
  modified_base (518)..(520): a, c, t, g, unknown or other
  misc_feature (518)..(520): n is a, c, g, or t
  modified_base (522)..(522): a, c, t, g, unknown or other
  misc_feature (522)..(522): n is a, c, g, or t
  modified_base (524)..(551): a, c, t, g, unknown or other
  misc_feature (524)..(551): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgacgaccgggagtacggttttactataggaaaaggttcgttctgcacatattggttggttggttttgatgtcgtggggccaggggacaagtggtcaccgtctcttcagcctccaccgacggcccagtccggttcccttcccccgtggccctacccctcctaccgaagacgccaccgtcgtcgggggccacgacggcccggccgtgggctcggcccgttgggtacgaacgggtacttacccgtttccgtaacgttacgaccgtcgtggacggcgggtcgtgggaccgtaaggggccgacgtacgtacgnnngngnnnnnnnnnnnnnnnnnnnnnnnnnnnn

SEQ ID NO: 151896 - DNA, 493 bp, Homo sapiens
  misc_feature: GYAE6OF02G3LMX.14.74.G08.1.454.CMB.1.raw
  modified_base (478)..(493): a, c, t, g, unknown or other
  misc_feature (478)..(493): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctgggccaggggacaatggtcaccgtctcttcagcctccaccgaacggcccatccggtccttcccccgtggccacccctcctccaacgacgccacctcgtcgggggctacgacgccggcccctggggcctcggcccgtgggtcgaacgggaccttacgttccgtaactacgacgctgagccgggctggcaaggcgcagtagnnnnnnnnnnnnnnnn

SEQ ID NO: 151897 - DNA, 504 bp, Homo sapiens
  misc_feature: GYAE6OF02F2EF4.14.74.G08.1.454.CMB.1.raw
  modified_base (483)..(504): a, c, t, g, unknown or other
  misc_feature (483)..(504): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccgaggggacaatggtcaccgtctcttcacgcctccaccaacgggcccagtccggtccttcccccgtggccacccctcctaccaagacgccacctcgtcgggggcacgacggccggcccgtgggctcggccgtgggtcaaggtactacgttccgtactacgacgcgtggacggcgggtctggacgaacggcgacgatagnnnnnnnnnnnnnnnnnnnnnn

SEQ ID NO: 151898 - DNA, 466 bp, Homo sapiens
  misc_feature: GYAE6OF02FVL6W.14.74.G08.1.454.CMB.1.raw
  modified_base (358)..(358): a, c, t, g, unknown or other
  misc_feature (358)..(358): n is a, c, g, or t
  modified_base (446)..(466): a, c, t, g, unknown or other
  misc_feature (446)..(466): n is a, c, g, or t
tcagcgtctagtaccacgaccggtgctcgatttagtagctctatcagggaagggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccagggccatcggtccttcccctggcaccctcctccaagncacctctggggcacgagcggccctgggctcgcctggtcaaggctacttccgtactagacgctgacgcgggctggcaaggcgcagtagnnnnnnnnnnnnnnnnnnnnn

SEQ ID NO: 151899 - DNA, 461 bp, Homo sapiens
  misc_feature: GYAE6OF02FZI4M.14.74.G08.1.454.CMB.1.raw
  modified_base (448)..(461): a, c, t, g, unknown or other
  misc_feature (448)..(461): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatcggtcttccccctggccacccctcctccaagagcacctcgtggggcacagcggccctgggctgcctggtcaaggactactccgtactagacgctgagcgggctggcaaggcgcatagnnnnnnnnnnnnnn

SEQ ID NO: 151900 - DNA, 493 bp, Homo sapiens
  misc_feature: GYAE6OF02JKGH1.14.74.G08.1.454.CMB.1.raw
  modified_base (473)..(493): a, c, t, g, unknown or other
  misc_feature (473)..(493): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatccggtcttccccctggccaccctcctccaagacgcacctcgtgggggcacacggccggccctgggcctcggccctgggtcaacgggaccttaccgttcccgtactacgaccgtctgacggcgggctggcaagggcgcgatagnnnnnnnnnnnnnnnnnnnnn

SEQ ID NO: 151901 - DNA, 625 bp, Homo sapiens
  misc_feature: GYAE6OF02GBB89.14.74.G08.1.454.CMB.1.raw
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (584)..(584): a, c, t, g, unknown or other
  misc_feature (584)..(584): n is a, c, g, or t
  modified_base (595)..(595): a, c, t, g, unknown or other
  misc_feature (595)..(595): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
tcagcgtctagtaccacgaccggtgctcgatttagtagctctatcaggggaagggacgtggacgtggattggcgaattactggcgtactgtacgagtgggggcaccaactacaacccctaccctcaagagtcgagtcaccttatctacgtagacgcgtccaaggtaagtcagttctcccttagaagcctgagctcgtgtgaccgccgcgagacacggccgcgtatttctgtgcgagacccgggaggaccggttttactagtagaaaaacggttccgttctgcacgacttattcggttggtcggttttcgattgtcgtcggggccaggggacaagtggtccgaccgtctacgttcacgccgtccgaccaacgggccagtcggtccttccccttggtcacccgtcctcgaacgtacgactacctcgtcggggcacgacggccgggacccggtggaccttcggccttcggtaccgaacggggaccttaaccgtcccgttaacttacggaacgctggaacgtcgggtctagggactaagggccgacacgtaaggntcgacgtngtacgngaccggtntcgntgcgagntagcacgctancgtacngcgtcgngtcgagtcgacgcgacg

SEQ ID NO: 151902 - DNA, 555 bp, Homo sapiens
  misc_feature: GYAE6OF02FZVIK.14.74.G08.1.454.CMB.1.raw
  modified_base (526)..(555): a, c, t, g, unknown or other
  misc_feature (526)..(555): n is a, c, g, or t
tcagcgtctagtaccacgaccggtgctcgatttagtagctctatcagggaagggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccagggggacaatggtcaccgtctcttcagcctccaccaagggcccatccggtccttccccctgggccacccctccctccaacggacgcacctcgtcggggggccacgacggccgggcccgtgggggcttcggcccttgggtaccgaacgggtaccttaccgtttcccggtaacctaaggaccgtcgtgacggtaccgggggtcctcggggaccgaaacgggtcggaccgtaagtaggcacgnnnnnnnnnnnnnnnnnnnnnnnnnnnnnn

SEQ ID NO: 151903 - DNA, 572 bp, Homo sapiens
  misc_feature: GYAE6OF02JQF4R.14.74.G08.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagcgtctagtaccacgaccggtgctcgatttagtagctctatcaggaagggacgtggagtggagttggcaatatgcatgacagtggggcgaccaacgtacaacccccgtccctcaagacgtcgagtcaccttatcactagacgcgtccaagagcagttttccctgaagctgagctctgtgaccgccgcagaccacggcccncgtaatttctgtgccgagtacccgggatacggttttctatgaaaaacggtcgttcnggcacatnttgtcgtgttttgatgtctgggcnggganatggtcnccgtntctcgagcctccgactacggcccatccggtcttaccccgngcacccctcctcgatccgctaccncgttcgggggccagacgccggtcccgtaggcctggcccttggtaacaaccggtccgtaccgtccggtaactcggaccgacccgtggaacgtcgggggacctccggcgtaaccggcggtcctaacgtgcgtnccgttaagngtacngcgtgcncgngttaacntcgcgcgcgngcngcgcgcgcgcgcgtgtcncngngcg

SEQ ID NO: 151904 - DNA, 531 bp, Homo sapiens
  misc_feature: GYAE6OF02JT6UO.14.74.G08.1.454.CMB.1.raw
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(502): a, c, t, g, unknown or other
  misc_feature (500)..(502): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(513): a, c, t, g, unknown or other
  misc_feature (511)..(513): n is a, c, g, or t
  modified_base (517)..(519): a, c, t, g, unknown or other
  misc_feature (517)..(519): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (526)..(531): a, c, t, g, unknown or other
  misc_feature (526)..(531): n is a, c, g, or t
tcagcgtctagtaccacgaccggtgctcgatttagtagctctatcagggaagggactggagtggattggcaatatgcatgacagtgggggcgaccaactacaacccctccctcaacgagtcgagtcaccttatcactagacgcgtccaagaagcagttctccctgaagctgagctctgtgaccgccgcagacacggccgcgtatttctgtgcgagaccgggagacgggtttactatgaaaaaggtcgttctagcacgatattgtggtgtttgatgtctgggccagggacatggtcacgtctcttcagcctccacacgggcccagtccggtccttccccgnggtccacccctcctccgaagacnccacctcgtggggcctacgacgccggcctgggtcgtcgccgtgggtcgaacggaccttacgtccggtaactacggacgctggaacggccggggtcgtcggaccgaacggtcgcgtaaacgtggntacgnagcngcgnnngcgngnngnnngcgnnncngnncnnnnnn

SEQ ID NO: 151905 - DNA, 572 bp, Homo sapiens
  misc_feature: GYAE6OF02GVWLM.14.74.G08.1.454.CMB.1.raw
  modified_base (543)..(572): a, c, t, g, unknown or other
  misc_feature (543)..(572): n is a, c, g, or t
tcagcgtctagtaccacgaccggtgctcgatttagtagctctatcagggaaggggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagacccgggagtacggtttactatgaaaaaggtcgttctgcacatattgttggtggttttgatgtctggggccaggggacaatggtcacgtctcttcagcctccaccgaacgggcccagtccggtccttcccccgtggcctacccctcccgtaccaacgacgccaccgtcgtcggggggaccacgacggccgggccccgtggggtccctcggtcccgttcgggtaccgaaacggggtaccgttaacccgtttacccggtaaccgttacggaccgtcgtacgggacgggcggggtccgttcgggacgaacgggtccggtacacgtagcagnnnnnnnnnnnnnnnnnnnnnnnnnnnnnn

SEQ ID NO: 151906 - DNA, 488 bp, Homo sapiens
  misc_feature: GYAE6OF02GHIPT.14.74.G08.1.454.CMB.1.raw
  modified_base (471)..(488): a, c, t, g, unknown or other
  misc_feature (471)..(488): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtcgtggggccaggggacaatggtcaccgtctcttcagcctccaccaacgggcccatccggtccttcccccgtggccacccctccctccaacgacgcacctcgtcgggggcacgacggcggcccgtgggctcggcctggtcaaggtacctacttccgtactacgacgcgtgacgcgggctcgggacaggcgcatagnnnnnnnnnnnnnnnnnn

SEQ ID NO: 151907 - DNA, 487 bp, Homo sapiens
  misc_feature: GYAE6OF02IUHTK.14.74.G08.1.454.CMB.1.raw
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
  modified_base (441)..(442): a, c, t, g, unknown or other
  misc_feature (441)..(442): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(462): a, c, t, g, unknown or other
  misc_feature (459)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (486)..(487): a, c, t, g, unknown or other
  misc_feature (486)..(487): n is a, c, g, or t
tcagcgtctagtaccacgaccggtgctcgatttagtagctctatcagggaaggggactggagtggattgggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactactgaaaaaaggtcgttctgcacatattgttggtgtttgatgtctgggccagggacaatggtcacgttctctcagcctccaccacgggcccatcggtctcccctggcacctcctcaancgcacctcgtcggggcacacgcgcctgggctcgctggcaaggctactcgatagacgctgagcgggctggcaaggcgacatagcncgtnngactancgagcananannnncncnacntnntncncncncactcnn

SEQ ID NO: 151908 - DNA, 434 bp, Homo sapiens
  misc_feature: GYAE6OF02GWB3H.14.74.G08.1.454.CMB.1.raw
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (417)..(417): a, c, t, g, unknown or other
  misc_feature (417)..(417): n is a, c, g, or t
  modified_base (421)..(434): a, c, t, g, unknown or other
  misc_feature (421)..(434): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaagtggtcaccgtctcttcagcctccacagggccatcggtctcccctgcncctctcagncactctgggcncagcgcctggctgctgcaggctactcctatagcgctgagcgggctggcaggcgcanagcnnnnnnnnnnnnnn

SEQ ID NO: 151909 - DNA, 554 bp, Homo sapiens
  misc_feature: GYAE6OF02HQ24I.14.74.G08.1.454.CMB.1.raw
  modified_base (521)..(521): a, c, t, g, unknown or other
  misc_feature (521)..(521): n is a, c, g, or t
  modified_base (524)..(539): a, c, t, g, unknown or other
  misc_feature (524)..(539): n is a, c, g, or t
  modified_base (541)..(554): a, c, t, g, unknown or other
  misc_feature (541)..(554): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgacccgccgcagacacggcccgcgtatttctgtgcgagacccgggagtacggttttacatagaaaaaggtcgttctgcacatattgttggttgttttgattgtcgtggggcaggggacaagtggtcaccgtctcttcacgtcctccaaccgaacggccccacgtccggttccttccccctggccctacccctcctaccaagacgcctaccgtcggtcgggggcacgacggcccggccgtgggccttggcccgttgggtaaccgaacggtccttaccgtttacccggtaactaacggacgtcgtggacgggcgggtccgtgggaccgaacgggtcacgtagagncgnnnnnnnnnnnnnnnngnnnnnnnnnnnnnn

SEQ ID NO: 151910 - DNA, 562 bp, Homo sapiens
  misc_feature: GYAE6OF02J0U5A.14.74.G08.1.454.CMB.1.raw
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (536)..(541): a, c, t, g, unknown or other
  misc_feature (536)..(541): n is a, c, g, or t
  modified_base (543)..(556): a, c, t, g, unknown or other
  misc_feature (543)..(556): n is a, c, g, or t
  modified_base (558)..(562): a, c, t, g, unknown or other
  misc_feature (558)..(562): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttcgtgtgcgagacccgggagacggtttactagtgaaaaaggtcgttacgtgcacagtattggttggtggttttgagtgtcgttggggccaggggtacaagtggtcaccgtctcgttcacgcctccacgacgggcccagttcgggtccttcccccgnggcctaccccgtcctaccgaagacgccacctcgcggggcacgcgccggtccgnggcctcggcccgtcgggtaccgaacgggaccttaccgttacccgttaagtacggaccgcgtacggtacggaccgggtcgttggggaccgtaaagggcccgtacgtaggtacgtncgagngcngnnnnnngnnnnnnnnnnnnnngnnnnn

SEQ ID NO: 151911 - DNA, 475 bp, Homo sapiens
  misc_feature: GYAE6OF02HKEJB.14.74.G08.1.454.CMB.1.raw
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (458)..(475): a, c, t, g, unknown or other
  misc_feature (458)..(475): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggtttttgatgtctggggccgagggggacaagtggtcaccgtctcttcacgcctccaccaacggcccatcggtccttcccctggccncccctcctccaagacnctacctcgtgggggcacgacgcggcctgggctgccgtggtcaaggctactccgtactaacgctgaggcggtcgtggcgaaggcgcatagnnnnnnnnnnnnnnnnnn

SEQ ID NO: 151912 - DNA, 467 bp, Homo sapiens
  misc_feature: GYAE6OF02F0H2X.14.74.G08.1.454.CMB.1.raw
  modified_base (434)..(434): a, c, t, g, unknown or other
  misc_feature (434)..(434): n is a, c, g, or t
  modified_base (456)..(467): a, c, t, g, unknown or other
  misc_feature (456)..(467): n is a, c, g, or t
tcagcgtctagtaccacgaccggtgctcgatttagtagctctatcagggaagggactggagtggattggcaatatgcatgacagtggggggcaccaactacaacccctccctcaagagtcgagtcaccttatcactagacgcgtccaagaagcagttctccctgaagctgagctctgtgaccgccgcagacacggccgcgtatttctgtgcgagaccccgggagacggttttactatgaaaaaggtcgttctgcacatattgttggtggttttgatgtctggggccagggggacaatggtcaccgtctcttcagcctccaccaagggcccatcggtcttccccctggccacccctcctccaacgacgcacctcgtcgggggcacaggcggccctgggctgcctggtcaaggactacttccgtactagacgctgngcgggctggcaaggcgcatcgnnnnnnnnnnnn

SEQ ID NO: 151913 - DNA, 451 bp, Homo sapiens
  misc_feature: GYAE6OF02G2RNB.14.74.G08.1.454.CMB.1.raw
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(451): a, c, t, g, unknown or other
  misc_feature (440)..(451): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatatgttggtggttttgatgtctggggccaggggacaatggtcaccgtctcttcagcctccaccaagggccatcggtctcccctggcacccctcctccaagancacctctggggcacagcggcctgggctgcctggcaaggactactccgtactagacgctgacgcgggntggcaaggcgnanagnnnnnnnnnnnn

SEQ ID NO: 151914 - DNA, 572 bp, Homo sapiens
  misc_feature: GYAE6OF02H109F.14.74.G08.1.454.CMB.1.raw
  modified_base (544)..(572): a, c, t, g, unknown or other
  misc_feature (544)..(572): n is a, c, g, or t
tcagcgtctagtaccacgaccggtgctcgatttagtagctctatcagggaagggactggagtggattggcaatatgcatgacagtgggggcaccaactacaaccccctccctcaagagtcgatttcaccttatcactagacgcgtccaagaagcagttctccctgaagctgagctctgtgaccgccgcagacacggccgcgtatttctgtgcgagacccgggagacggttttactatagaaaaaggtcgttctgcacatagttgttggttggttttgatgtcgttgggcgagggacaatggtcaccgtctcttcacgcctccaccgaacgggcccacgttccggttcctttccccccgtcgggtccctaccccctcccgttacccgaagacgccacccgttccggtacggggggccaaccgacggccggccccgtcggggcctccggtccgttcgggtaccaacgggtaccttaaccgtttcccggtaacgtacggaccgtcgtggaacggccgggcgtcggacgtaacggcgacacgtagcannnnnnnnnnnnnnnnnnnnnnnnnnnnn

SEQ ID NO: 151915 - DNA, 500 bp, Homo sapiens
  misc_feature: GYAE6OF02IFNBB.14.74.G08.1.454.CMB.1.raw
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (468)..(468): a, c, t, g, unknown or other
  misc_feature (468)..(468): n is a, c, g, or t
  modified_base (470)..(471): a, c, t, g, unknown or other
  misc_feature (470)..(471): n is a, c, g, or t
  modified_base (474)..(500): a, c, t, g, unknown or other
  misc_feature (474)..(500): n is a, c, g, or t
tcagcgtctagtaccacgaccggtgctcgatttagtagctctatcaggggaagggactggagtggattggcaatatgcatgacagtgggggcaccaactacaacccctccctcaagagtcgagtcaccttatcactagacgcgtccaaagaagcagttctccctgaagctgagctctgtgaccgccgcagacacggccgcgtatttctgtgcgagacccgggagtacggttttacatagaaaaaggtcgttactgcacatattgttggtggttttgatgtcgtgggccgaggggacaagtggtcaaccggttctcttcacgcctaccaccgaaggccagtccggtcttccccngcaccctcctccaagacncactcgnggggcacgtacgccggccctggctcgctggcaaggactacgttccgtacagacgctagcggcgggctcggcgaaagggccacgaagtcgnannagnnnnnnnnnnnnnnnnnnnnnnnnnnn

SEQ ID NO: 151916 - DNA, 570 bp, Homo sapiens
  misc_feature: GYAE6OF02G8IVK.14.74.G08.1.454.CMB.1.raw
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (543)..(545): a, c, t, g, unknown or other
  misc_feature (543)..(545): n is a, c, g, or t
  modified_base (547)..(547): a, c, t, g, unknown or other
  misc_feature (547)..(547): n is a, c, g, or t
  modified_base (549)..(552): a, c, t, g, unknown or other
  misc_feature (549)..(552): n is a, c, g, or t
  modified_base (555)..(556): a, c, t, g, unknown or other
  misc_feature (555)..(556): n is a, c, g, or t
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(570): a, c, t, g, unknown or other
  misc_feature (565)..(570): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgttatttctgtgcgacgaccgggagtacggttttactatagaaaaaggtcgttctgcacattattgttggttggttttgagttgtcggtgggccgaggggacaagtggtcctacgtctcttcgacgtccctccgaaccgacgggccctagtccggttcctccccgtggccctacccctcctaccgaacgtacgacctccgtcggtcggggcacgacgggccggtcccgtggcgtcgcccgtggtacgaacggtacctaccgtttccgtaacctaggaccgtcgtcggacggtcgggtacgtcggacgaacggggtccgacgaagtcgagtnagtcgntcgangcnnngncnnnncgnncnngngncnnnnnn

SEQ ID NO: 151917 - DNA, 500 bp, Homo sapiens
  misc_feature: GYAE6OF02IYO85.14.74.G08.1.454.CMB.1.raw
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
  modified_base (478)..(500): a, c, t, g, unknown or other
  misc_feature (478)..(500): n is a, c, g, or t
tcagcgtctagtaccacgaccggtgctcgatttagtagctctatcagggaagggactggagtggattggcaatatgcatgacagtgggggcaccaactacaacccctccctcaagagtcgagacaccttatcactagacgcgtccaaagaagcagttcttacccctgaaagcctgagctctggtgaccgccgcagacacggccgcgtatttctgtgcgagacccgggagtacggttttacagtagaaaaaggtcgttctcgtcacattagttggttggttggtttttgattggtcgtggggccaggggacaagtggtcaccgtctcttcagcctcaccgaggccatcgtcctcccctgcnccctcncaangccactcgtcggggcacgtcgccgtccgcggctcgccctggtacgaaggaccttacttcccgatacgcgtacnggaggccgggtctcggganaaggtccagtanacgnnnnnnnnnnnnnnnnnnnnnnn

SEQ ID NO: 151918 - DNA, 528 bp, Homo sapiens
  misc_feature: GYAE6OF02G9PSB.14.74.G08.1.454.CMB.1.raw
  modified_base (498)..(501): a, c, t, g, unknown or other
  misc_feature (498)..(501): n is a, c, g, or t
  modified_base (503)..(508): a, c, t, g, unknown or other
  misc_feature (503)..(508): n is a, c, g, or t
  modified_base (510)..(528): a, c, t, g, unknown or other
  misc_feature (510)..(528): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagtaccggttttactatagaaaaaggtcgttctgcacatattgttggtggttttgatgtcgtggggccaggggacaatggtcaccgtctcttcacgcctccaccgacgggccctagttcggtccttcccccgtggccctacccctccctaccaacggacgccacctcggtcgggggacacgcggccggcccgtgggctcggtccgtgggtcgaacggtacttaccgttccggtactaggccgtctggacggtcgggcgtggacgaacggcgcgatagnnnngnnnnnngnnnnnnnnnnnnnnnnnnn

SEQ ID NO: 151919 - DNA, 572 bp, Homo sapiens
  misc_feature: GYAE6OF02JKDTI.14.74.G08.1.454.CMB.1.raw
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
  modified_base (555)..(556): a, c, t, g, unknown or other
  misc_feature (555)..(556): n is a, c, g, or t
  modified_base (559)..(572): a, c, t, g, unknown or other
  misc_feature (559)..(572): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatggaaaaaggttcgttctgcacatattgttggttggttttgatgtctggggccaggggacaagtggtcgaccgtctcgttcagtcctccaccgaacgggcccaacgttccggtaccttcccccgtggtaccctacccctcctaccaagacgcctacccgtcggtcgggggccacgaacggtccggcccgtaggggcctacggtccgtcgggtcgaacggaccttaccggttcccgtactaacggccgacgttcggacggcgggcgtaggaccgtaacgggaccgcgatacggnactgacgtnagngcagcagngcatcggnncgnnnnnnnnnnnnnn

SEQ ID NO: 151920 - DNA, 653 bp, Homo sapiens
  misc_feature: GYAE6OF02H2NLN.14.74.G08.1.454.CMB.1.raw
  modified_base (579)..(579): a, c, t, g, unknown or other
  misc_feature (579)..(579): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
  modified_base (620)..(620): a, c, t, g, unknown or other
  misc_feature (620)..(620): n is a, c, g, or t
  modified_base (643)..(643): a, c, t, g, unknown or other
  misc_feature (643)..(643): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagaccgggagtacggttttactatagaaaaggtcgttctgcacatatgttggtgtttgatgtcgtgggccagggacaagtggtcacgtctcttcgacgtcctccgaccgaacgggcctaacgtccggttccttccccccgtgggtcccaccccgttcccgtcccaaaggaccgcctaacccgttccggtcgggggacctacggacggtcccggcccgttagggccgttcggtcccgttaggtaccgtaacgggtactttacccgtttaccccggtaacgttaaccggaccggtaccgttagggaccggtcggggtacggtacgtaccggaaacgggccgtaacgtacgttaagcgtcgtagcgtacgngccagtccagccttagcgnggttanacgtctaggcccggtntacgcgtcgtcgacgtgcgtacngtcgtcgtag

SEQ ID NO: 151921 - DNA, 507 bp, Homo sapiens
  misc_feature: GYAE6OF02GHUTT.14.74.G08.1.454.CMB.1.raw
  modified_base (491)..(495): a, c, t, g, unknown or other
  misc_feature (491)..(495): n is a, c, g, or t
  modified_base (497)..(507): a, c, t, g, unknown or other
  misc_feature (497)..(507): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagagcagttctccctgaagctgagctctgtgaccgccgcagacacggccgcgtatttctgtgcgagacccgggagacggtttactatagaaaaaggtcgttctgcacatattgttggtggttttgatgtctggggccaggggacaatggtcaccgtctcttcagcctccaccgacgggccccagtccggtcccttcccccgtggcccacccctccctccaacgacgcctaccctcgtcgggggcacgaggccggcccgtcggggctcggccgtgggtaccgaagggacctacgttcccgtacttaggaccgtctggacggcgggcgtggctacgggcgcatagnnnnncnnnnnnnnnnn

SEQ ID NO: 151922 - DNA, 615 bp, Homo sapiens
  misc_feature: GYAE6OF02JMB18.14.74.G08.1.454.CMB.1.raw
  modified_base (380)..(380): a, c, t, g, unknown or other
  misc_feature (380)..(380): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (571)..(572): a, c, t, g, unknown or other
  misc_feature (571)..(572): n is a, c, g, or t
  modified_base (605)..(605): a, c, t, g, unknown or other
  misc_feature (605)..(605): n is a, c, g, or t
  modified_base (612)..(612): a, c, t, g, unknown or other
  misc_feature (612)..(612): n is a, c, g, or t
tcagcgtctagtaccacgaccggtgctcgatttagtagctctatcaggagggactggagtggattggcaatatgcatgacagtgggggcaccaactacaaacccctccctcaagagtcgagtcaccttatcactagacgcgtccaacgaagcagttctccctgaagctgagctctgtgaccgcgctagacacggccgcgtattctgtgcgagacccgggagtaccggttttactagtacgaaaaagggttcgttacgtgctactaatacttggttggttaggttttggaatgtcgttgggccgaggggtacaaagtcggtcgaacgttctacgttcacgtcctccgacgaacgggcccctagtccggtcctttcccccgnggtccctaccccgttcccgtacccgaagacgaccctacccgtacgttcgggggacctacgacggtccggcccgtgggccctggacccgttgggtaccaagggtcctacttaccgactacgcgtccgtggaggtcgggcctcgggactaacgggccacgtaacgtgtaccgngacngactgncgacagcacnncgcgacgtacgtagcacacgacacgacgcacgncgacacnacg

SEQ ID NO: 151923 - DNA, 616 bp, Homo sapiens
  misc_feature: GYAE6OF02JD1SW.14.74.G08.1.454.CMB.1.raw
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(596): a, c, t, g, unknown or other
  misc_feature (593)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(604): a, c, t, g, unknown or other
  misc_feature (602)..(604): n is a, c, g, or t
  modified_base (607)..(608): a, c, t, g, unknown or other
  misc_feature (607)..(608): n is a, c, g, or t
  modified_base (610)..(612): a, c, t, g, unknown or other
  misc_feature (610)..(612): n is a, c, g, or t
  modified_base (614)..(616): a, c, t, g, unknown or other
  misc_feature (614)..(616): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttactgcacatattgttggtggtttttgagttgtctggggccaggggacaagtggtcaccggtctcttcagcctccaccgtaacgggcccacttccgggtacctttccccccgttgggcctacccccgttccctacccgtaaacgacgcccaacccgtttccgtcgggggggtcccaaccgagggccggtccccgtgggggtcctcggcccgtgggtccgaaacgggtaccttaccgtttaccggttaaccgtacggaccgtcgttacggacggtccggggccgttcggggaccgtaaggggccgtaccgaacggttacgacgtnacgngcgngnngngcgcncngnnnngngncnnncgnncnnncnnn

SEQ ID NO: 151924 - DNA, 542 bp, Homo sapiens
  misc_feature: GYAE6OF02JYKQR.14.74.G08.1.454.CMB.1.raw
  modified_base (376)..(376): a, c, t, g, unknown or other
  misc_feature (376)..(376): n is a, c, g, or t
  modified_base (516)..(542): a, c, t, g, unknown or other
  misc_feature (516)..(542): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtattctgtgcgagacccgggagtacggttttactatagaaaaaggtcgttactgcacatattgttggtggttttgatgtcgtggggccgaggggactaatgggtcacgtctcttcagtcctccaaccgacgggtcccagtccggtccttccccgtggcccaacccctcctaccgaanacgcctaccgtcgtcgggggaccaacgccggtcggccccgtggggcctcggccgttacgggtccaacgggtaccttaccttacccgtacgttaacgacgccgtaggacggcgggtcgtgggaccaagggcgctaacgagnnnnnnnnnnnnnnnnnnnnnnnnnnn

SEQ ID NO: 151925 - DNA, 542 bp, Homo sapiens
  misc_feature: GYAE6OF02GB4YL.14.74.G08.1.454.CMB.1.raw
  modified_base (516)..(517): a, c, t, g, unknown or other
  misc_feature (516)..(517): n is a, c, g, or t
  modified_base (519)..(542): a, c, t, g, unknown or other
  misc_feature (519)..(542): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagtacggttttactataggaaaaaggtcgttctgcacatattggttggttggttttgattgtcgtggggcgaggggacaagtggtcaccgtctctcacgcctccaccgacgggcccacgtccggtccttcccccgtggcctacccctcctaccaagacgcctaccgtcgtgggggccacgacggccggcccgtgggctcggcccgtggtacgaacggtaccttaccgttcccgtaacgtacgtaccgcgtaggacgggccggggtccgtcgggaccggaagggccgacgaagtagnngnnnnnnnnnnnnnnnnnnnnnnnn

SEQ ID NO: 151926 - DNA, 553 bp, Homo sapiens
  misc_feature: GYAE6OF02H05C5.14.74.G08.1.454.CMB.1.raw
  modified_base (518)..(519): a, c, t, g, unknown or other
  misc_feature (518)..(519): n is a, c, g, or t
  modified_base (524)..(527): a, c, t, g, unknown or other
  misc_feature (524)..(527): n is a, c, g, or t
  modified_base (529)..(553): a, c, t, g, unknown or other
  misc_feature (529)..(553): n is a, c, g, or t
tcagcgtctagtaccacgaccggtgctcgatttagtagctctatcagggaagggactgtagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtgtttgatgtctgggccagggacaatggtcacgtctcttcacgcctccaccgaacgggccccagttccggtccttccccctggccacccctccctaccaacgacgcctacctcggtcgggggccacgacggccggccccgtagggcctcggtcccgtgggtaccgaacggtaccttaccgtttacccgtaccgtaacggtacgtcctaggacggacggggtcgtcgggacgtaacggggccgacagttaacggnngacgnnnngnnnnnnnnnnnnnnnnnnnnnnnnn

SEQ ID NO: 151927 - DNA, 398 bp, Homo sapiens
  misc_feature: GYAE6OF02JGZYO.14.74.G08.1.454.CMB.1.raw
  modified_base (295)..(295): a, c, t, g, unknown or other
  misc_feature (295)..(295): n is a, c, g, or t
  modified_base (376)..(376): a, c, t, g, unknown or other
  misc_feature (376)..(376): n is a, c, g, or t
  modified_base (382)..(398): a, c, t, g, unknown or other
  misc_feature (382)..(398): n is a, c, g, or t
tcagcgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaagtggtcaccgtctcttcagcctccaccaaggcccatcggtcttccccctggccaccctcctaccaagacgcaccncgtggggcacgagccggccctgggctcgccgtcggtacaaggactacttccgtactagacgctgaggcggctggcaaggcncatagnnnnnnnnnnnnnnnnn

SEQ ID NO: 151928 - DNA, 634 bp, Homo sapiens
  misc_feature: GYAE6OF02G1NHZ.14.74.G08.1.454.CMB.1.raw
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
  modified_base (614)..(627): a, c, t, g, unknown or other
  misc_feature (614)..(627): n is a, c, g, or t
  modified_base (629)..(634): a, c, t, g, unknown or other
  misc_feature (629)..(634): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgccgcagacacggccgcgtatttctgtgcgagaccgggaggtacggttttacatagtaaaaggtcgtctgcacatattgttggttggtttgatgtcgtggggcgagggactagtcggtctaccgtctctcgacgcctccgaaccgaacgggcccacgttccggttcccttcccccgtggtccctaccccgtccctccgaaacgtccgcctaaccgtcgggtcgggggaccaccggacgggtcccgggtacccggtcggggtacccgtcggtcccggttacgggttaccgtaaacggggtaccctttacccggtttaccccggttaagttacggacccgtcggttacgggacggggtttccggggtaccgtacggggaccgttaaacggggccgtaccgtaaaggtcgcgcgtacgctagctagccnngncgnnnnnnnnnnnnnngnnnnnn

SEQ ID NO: 151929 - DNA, 501 bp, Homo sapiens
  misc_feature: GYAE6OF02GF2IL.14.74.G08.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (468)..(469): a, c, t, g, unknown or other
  misc_feature (468)..(469): n is a, c, g, or t
  modified_base (472)..(472): a, c, t, g, unknown or other
  misc_feature (472)..(472): n is a, c, g, or t
  modified_base (476)..(501): a, c, t, g, unknown or other
  misc_feature (476)..(501): n is a, c, g, or t
tcagcgtctagtaccacgaccggtgctcgattttagtagctctatcagggaagggactggagtggattggcaatatgcatgacagtgggggcaccaactacaacccctccctcaagagtcgagtcaccttatcactagacgcgtccaagaagcagttctccctgaagctgagctctgtcgaccgccgcacgacgacggccgcgtatttctgtgcgagacccgggagtacggtttactataggaaaaaggtcgttctgcacattattgttggtgttttgatgtctgggcagggacagtgtcactctctacncgcctaccacgacggccatcgtccttcccngcctccctcacaacgnccactcgtcggggcaagcggcggtccngggcctcgcgtcggactaacgtaccttacgttccgtaanacggtacgngtcgacggcggtcgtcggacgaggcgacgtaacgtgnncgncagnnnnnnnnnnnnnnnnnnnnnnnnnn

SEQ ID NO: 151930 - DNA, 521 bp, Homo sapiens
  misc_feature: GYAE6OF02IOFLS.14.74.G08.1.454.CMB.1.raw
  modified_base (323)..(323): a, c, t, g, unknown or other
  misc_feature (323)..(323): n is a, c, g, or t
  modified_base (376)..(376): a, c, t, g, unknown or other
  misc_feature (376)..(376): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
  modified_base (498)..(521): a, c, t, g, unknown or other
  misc_feature (498)..(521): n is a, c, g, or t
tcagcgtctagtaccacgaccggtgctcgattttagtagctctatcagggaaggggactggagtggattgggcaatatgcatgacagtgggggcaccaactacaaccccctcccctcaagagtcgagtcaccttatcactagacgcgtccaagaagcagttctccctgaagctgagctctgtgaccgccgcacgacacggccgcgttatttctgtgcgaggaccgggagtacgttttactatagaaaaggtcgttctgcacatattgttggtggttttgattgtcgtggggccgaggggactaagtggtcaccgttctcttcncgcctccaccgaacgggcccagtcggttaccttcccccgtgtccacccctccnccagacgcaccgtcgtgggggccagacggccggcccgtgggctcggcgtcgtacgaggtactaccgtttaccgactacgacgctcgacgggcggcggtcggacgacggcgacgntagctngnnnnnnnnnnnnnnnnnnnnnnnn

SEQ ID NO: 151931 - DNA, 538 bp, Homo sapiens
  misc_feature: GYAE6OF02G3P2P.14.74.G08.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (510)..(511): a, c, t, g, unknown or other
  misc_feature (510)..(511): n is a, c, g, or t
  modified_base (513)..(513): a, c, t, g, unknown or other
  misc_feature (513)..(513): n is a, c, g, or t
  modified_base (515)..(538): a, c, t, g, unknown or other
  misc_feature (515)..(538): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgngtatttctgtgcgaggacccgggagtacggttttactatagaaaaaggtcgttctgcactatattgttggttggtttgatgtcgtggggccaggggacaagtggtcnccgtctctcacgcctccaccgacgggcctacgtcgttccttccccgtggccacccctcctccaacgactcnccgtcgtcggggccacgacggtcggccgtcgggccgtcggccgtcggacgtacggtacgttacccgttccgtactacggcgtcgtacgggacggcgggtcgtcgggcgtaaacgggccacagangtangcgtannangnnnnnnnnnnnnnnnnnnnnnnnn

SEQ ID NO: 151932 - DNA, 597 bp, Homo sapiens
  misc_feature: GYAE6OF02J01UK.14.74.G08.1.454.CMB.1.raw
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (457)..(457): a, c, t, g, unknown or other
  misc_feature (457)..(457): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
  modified_base (592)..(592): a, c, t, g, unknown or other
  misc_feature (592)..(592): n is a, c, g, or t
tcagcgtctagtaccacgaccggtgctcgatttagtagctctatcagggaagggactggagtggattggcaatatgcatgacagtgggggcaccaactacaaccccctccctcaagagtcgagtcaccttatcactagacgcgtccaagaagcagttctccctgaagctgagctctgtgaccgaccgcagacacggccgcggtatttcgtgtgcgagaccgggagtacgtttactatagaaaaggttctgtgcanatattgttggtggtttnatgtcgtgggacgagggacaagtggacctaccgtnttccgtcacgcctaccgaccgacggccctacgtcgtccgttccccaggcctaccccgcctacgacgacgccgtcgtcgtacgggacacacggcgtacccgtggacctcggccctagggtaccgaaggtctcggtacgttccgttaaacgnggtaccgtcgtagggtacccggggcgttcggtcggaacgtacggggaactcgtaacaggtccggaancgtacgcncgtacgcgtgacgtnacgtgtacncgngcgcgacgcgngcggtcgngtacactcgtcgtntagtc

SEQ ID NO: 151933 - DNA, 643 bp, Homo sapiens
  misc_feature: GYAE6OF02FOR3X.14.74.G08.1.454.CMB.1.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
  modified_base (582)..(582): a, c, t, g, unknown or other
  misc_feature (582)..(582): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctganctctgtcgaccgccgcagacgacggccgcgttatttcngtgcgacggaccgggagtacggtttactagtagaaaaggtcgttcgtgacacattattggttggttggtttagagtgtcgcgggcgagggacaagtgtcaccgtctctcgcgtcctaccgaaccgtaacggcctacgtccggtccctttcccccgtcgaccgtccccttaccctaccaacgtacgacccgtaccgttcgggtaccgggggacaccggtacggtcccggaccccggttcggggtccgtcggtcccggttacggacgtaaccgggtactttaccgttacccgtaacgtaccggaccggtacggttaacgggacgggtccggggtacgtacggggaaccgttaaccgggcggtaacgtacgacggngacgctcagcgagtcgcncncgtnatgancgcgngcncacgcgngcncngncgtcngtcgc

SEQ ID NO: 151934 - DNA, 535 bp, Homo sapiens
  misc_feature: GYAE6OF02F3VGN.14.74.G08.1.454.CMB.1.raw
  modified_base (311)..(311): a, c, t, g, unknown or other
  misc_feature (311)..(311): n is a, c, g, or t
  modified_base (502)..(503): a, c, t, g, unknown or other
  misc_feature (502)..(503): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(535): a, c, t, g, unknown or other
  misc_feature (510)..(535): n is a, c, g, or t
tcagcgtctagtaccacgaccggtgctcgatttagtagctctatcagggaagggacgtggagtgggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagaccccgggagacggttttactatgaaaaagtcgttctgcacatattgttggtggttttgatgtctggggccaggggacaatggtcacgtctcgttnagcctcaccaagggccaatcggtccttcccctggcaccctcctccaagagcacctcgtacggggcacgagccggccctggggccttggcccgtggtacgaaacgggtactacgtttcccgaacgttacggccgtactcggagcccggggtcgtacgggacgtaaaacgggccggaaccttaagtaagacgnngcngngnnnnnnnnnnnnnnnnnnnnnnnnnn

SEQ ID NO: 151935 - DNA, 566 bp, Homo sapiens
  misc_feature: GYAE6OF02HXXD4.14.74.G08.1.454.CMB.1.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (503)..(504): a, c, t, g, unknown or other
  misc_feature (503)..(504): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
  modified_base (549)..(550): a, c, t, g, unknown or other
  misc_feature (549)..(550): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
tcagcgtctagtaccacgaccggtgctcgatttagtagctctatcagggaagggactggagtggattggcaatatgcatgacagtgggggcaccaactacaacccctccctcaagagtcgattcaccttatcactagacgcgtccaagaagcagttctccctgaagctgagctctgtgaccgccgcagacacggccgcgtatttctgtgcgacgaccgggagtacggttttactatagaaaaggtccgttacngtcanagtatttgttggttggttttgatgtcgtggggcgagggacagtgtcgaccgtctcttcgacgcctaccacggaacggtcccagtccggttccctccccgtggtccaccctcctaccgaagacgcctaccgtcggtcggggacacgcggccggtccgtacggctacgccgttgtaccgacgtacctacgttccgtaagtacgcgacgtggacggccggtcgtacggactacgggctacgagtacgnngtagnagcagtgctcganctaagctgacgtnacgcgtntcgtcgnngcgtcacnacnctgcg

SEQ ID NO: 151936 - DNA, 838 bp, Homo sapiens
  misc_feature: GYAE6OF02JI5GY.14.74.G08.1.454.CMB.1.raw
  modified_base (765)..(765): a, c, t, g, unknown or other
  misc_feature (765)..(765): n is a, c, g, or t
  modified_base (771)..(771): a, c, t, g, unknown or other
  misc_feature (771)..(771): n is a, c, g, or t
  modified_base (778)..(778): a, c, t, g, unknown or other
  misc_feature (778)..(778): n is a, c, g, or t
  modified_base (783)..(783): a, c, t, g, unknown or other
  misc_feature (783)..(783): n is a, c, g, or t
  modified_base (817)..(817): a, c, t, g, unknown or other
  misc_feature (817)..(817): n is a, c, g, or t
  modified_base (824)..(824): a, c, t, g, unknown or other
  misc_feature (824)..(824): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgacgtccaagaagcagttctcctgaagcctgagctctgtcgaccgccgcacgacgtacggccgcgtactttcgtcgtcgcgtacgacccgggtaggtaccggttttacctagttaaggtaaaaaacggttcgttacgtacgtaccgtaactaagtttaaccgttggtttaagggttggtttttaagaacgttcggttccggttagggggacccgtaaggggtaccgttaaagttcgggtaaccctaaccggttccgttaccgtttaccgaccggttacccccgttaacccgtaacccgtaaccgggtaccccctaacggtttcccccgggttaacccgtttaccccccggtcgggtaaccccttaacccccgttacccggtaaccccgtaaaacggaccgtacccgtaacccggtttaccggaccgggggtacctaaccggtacggtaccccgggtcccgtacgggttaccgtcggtaccgtttaccggaacggtaacccgtaccgtttaaacccgttcccggttaaccgttaaggtaacccgttccggtaaaggttcccgggtaccgggtaccgttacgggacgtaaaccgggtcgtaaccgtaagttaacgcgacgtgaaccgtntacgtntaaccgnggtancgttacacggatacggcagtgcgattagcgtaancctagtnacctgccctgacgc

SEQ ID NO: 151937 - DNA, 870 bp, Homo sapiens
  misc_feature: GYAE6OF02JO2DZ.14.74.G08.1.454.CMB.1.raw
  modified_base (170)..(170): a, c, t, g, unknown or other
  misc_feature (170)..(170): n is a, c, g, or t
  modified_base (519)..(519): a, c, t, g, unknown or other
  misc_feature (519)..(519): n is a, c, g, or t
  modified_base (796)..(796): a, c, t, g, unknown or other
  misc_feature (796)..(796): n is a, c, g, or t
  modified_base (801)..(801): a, c, t, g, unknown or other
  misc_feature (801)..(801): n is a, c, g, or t
  modified_base (818)..(818): a, c, t, g, unknown or other
  misc_feature (818)..(818): n is a, c, g, or t
  modified_base (848)..(848): a, c, t, g, unknown or other
  misc_feature (848)..(848): n is a, c, g, or t
tcagcgtctagtaccacgaccggtgctcgatttagtagctctatcagggaagggactggagtggattggcaatatgcatgacagtggggcaccaactacaacccctccctcaagagtcgagtcaccttatcactagacgcgtaccaaggaagctacgttctaccccgtanaccggtaccgtgtagtccgttcgtaccgttcggacccgccggaccaacgggaaccgaccggtacgtccgttagtttcgtcggtagacccggtaggaccccggggtttatacgggtttttaacggtaaagttcggttaaaaacgggttcgttaccgtacgaccgtacttacgtttaggtttagggttttcgggtttaaggttttaggtcggtttcgggaccgggtttacggggggaaccccggtaagggggtaaccgtaggtttaaccgggttacccggttaccccgttaacggtttacgttccccccggaaaaccttaccccggtaacccgggttaaacccccgggttnaacccggttacccggttacccgttacccggttacccggttaccccggtacccgtacccgtacccgtaccgtaaccgtaacggtaccgtaccgtaccggtaccggtaccggtacccgacccgaccggtaccggtcccgtaccgggtaccggtaccggtaccggtacggtacgttacggtaccgttaccgttaccgtaccggtacggtacggtacgggtacgggtacggtaccggacggtacggtacggtaccggtacgacgtacgagtacgtcgacgngtagngcgtcgacgtgtatcgngacgtcgtacgacgtctccgagtagtacgngcgtcatacgacgtactacgtc

SEQ ID NO: 151938 - DNA, 593 bp, Homo sapiens
  misc_feature: GYAE6OF02HMRMN.14.74.G08.1.454.CMB.1.raw
  modified_base (318)..(318): a, c, t, g, unknown or other
  misc_feature (318)..(318): n is a, c, g, or t
  modified_base (560)..(564): a, c, t, g, unknown or other
  misc_feature (560)..(564): n is a, c, g, or t
  modified_base (566)..(568): a, c, t, g, unknown or other
  misc_feature (566)..(568): n is a, c, g, or t
  modified_base (570)..(574): a, c, t, g, unknown or other
  misc_feature (570)..(574): n is a, c, g, or t
  modified_base (576)..(578): a, c, t, g, unknown or other
  misc_feature (576)..(578): n is a, c, g, or t
  modified_base (580)..(593): a, c, t, g, unknown or other
  misc_feature (580)..(593): n is a, c, g, or t
tcagcgtctagtaccacgaccggtgctcgatttagtagctctatcagggaagggactggagtggattggcaatatgcatgacagtgggggcaccaactacaacccctccctcaagagtcgagtcaccttatcactagacgcgtccaaagaagcagttctccctgaagctgagctctgtgaccgccgcagacacggccgcgttattcgtgtcgcgagacccgggagtacggttttactaatagaaaaaggtcgttctgtcacatattgttggttggttttgattgtcgtggggcccaggggactaagtgtcgaccgttntcttcacgtcctccaccgacgggtcccagtccggttccttcccccgtggccctacccctcctaccgaagaccgcctaccctgggtcggggactaaccgacggcccgggtccccgtggggcccgttcgcccgttacgggtaccgtaaaggtaacccttacccgtttaccgttaaccgtacgggacgtcttacgggaacggtccggggtacttcgggaccggttaacggccgactaagtagcgnnnnngnnncnnnnngnnngnnnnnnnnnnnnnn

SEQ ID NO: 151939 - DNA, 601 bp, Homo sapiens
  misc_feature: GYAE6OF02GKHL0.14.74.G08.1.454.CMB.1.raw
  modified_base (448)..(448): a, c, t, g, unknown or other
  misc_feature (448)..(448): n is a, c, g, or t
  modified_base (565)..(565): a, c, t, g, unknown or other
  misc_feature (565)..(565): n is a, c, g, or t
  modified_base (571)..(571): a, c, t, g, unknown or other
  misc_feature (571)..(571): n is a, c, g, or t
  modified_base (578)..(601): a, c, t, g, unknown or other
  misc_feature (578)..(601): n is a, c, g, or t
tcagcgtctagtaccacgaccggtgctcgatttagtagctctatcagggaagggactggagtggattggcaatatgcatgacagtgggggcaccaactacaacccctccctcaagagtcgattcaccttatcactagacgcgtccaagaagcagttctaccctgaagctgagctctgtgaccgccgcagacacggccgcgtatttctgtgcgacgacccgggagtacggttttactatagaaaaaggtcttctgcacatattgttaggttggttttacgattgtcgtcggggccagggggacctaagtcggtcaccgttctcttcacgccctccaccgaacggccctagtccggtccttcccccgtcgggcctaccccgttccctaccgaacggacgacccgtacctggtcggggaccacgtacggcccgggtacccgtcggggtccncggtccgttcgggtaactaacggggtaacctttacccgttcccgtaaacgtaccggtacgtaccgtgtaaccggggccgggtccgtacgggcgtaaaacggcggtacctaagtacgntagctncagctgnnnnnnnnnnnnnnnnnnnnnnnn

SEQ ID NO: 151940 - DNA, 562 bp, Homo sapiens
  misc_feature: GYAE6OF01D263O.9.6.A06.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
tcagtgatacgtctcacgaccggtgctcgatttagatctactgacaacgacacaagggggaggaactgctcagttaggacccagagggaaccatggaagccccagctcagcttctcttcctcctgctactctggctcccagattccaccgganaagttgtgttgacacagtctccagccaccctgtctttgtctccgaggggaaanagccaccctctcctgcagggccagtcagagtcttaggagctccttagcctggtatcaacagaaacctggccaggctccaggctactcatctatcgatgcatcccaaacgcgggccactggcactcccagccaggttcagtggcaggtggctgggacagacttcactcncacntcagcagactaganctagatatttgcttagtttatactgtacagcaggcgtacgacacgtcggcccgttcggtaccgttcggaaccgaaacgggacccgtaaaaggtacggaaccgtacgtacgaaacggtccgtaaaccgttcgggtacggtcccttacgaccctacccgtacgtccgttacg

SEQ ID NO: 151941 - DNA, 692 bp, Homo sapiens
  misc_feature: GYAE6OF01C12PJ.9.6.A06.1.454.CMB.1.raw
  modified_base (341)..(341): a, c, t, g, unknown or other
  misc_feature (341)..(341): n is a, c, g, or t
  modified_base (681)..(681): a, c, t, g, unknown or other
  misc_feature (681)..(681): n is a, c, g, or t
tcagtgatacgtctcacgaccggtgctcgatttagatctactgacgaacacgacaagggggaggactgctcagttaggaccagagggaaccatggagcccagctcagcttctcttcctcctgctactctgggctcccgagattccaccgggtagaagttgtgttgtaacacgagtctccagccacccttgtcctttggtctccgagggggaaagagccgaccctctcctggcagggccagtcagtacgtcttaggagctccgttagcctggtattcaacaagaaacctggaccaggtcctaccgaggcctccgtcactctatcgatcgacataccgaacgngggccacgtggactactcccagtccgtaaggttcaaggttcggactaggtcgggtactggggactagtacctttcgaacttccgtacaacctatccaacgctaacgacgtaagacgtaccgtaaggtaaaacgttcttttacggactttaaggttttaacttaaccgttacggttaccgaagtaccgtaacggtacgtaacggtacctaaaccgggtcgggtacccgttacgggtaaccggtttcgggaacccggtaaacgggtaaccggtaaaggtcgggaacgtaacgttacgaaacggtcgtaaacggttggtacggtaccgtacgacggtaacccngttccgttacg

SEQ ID NO: 151942 - DNA, 842 bp, Homo sapiens
  misc_feature: GYAE6OF01BSS2P.9.6.A06.1.454.CMB.1.raw
  modified_base (196)..(196): a, c, t, g, unknown or other
  misc_feature (196)..(196): n is a, c, g, or t
tcagtgatacgtctcacgaccggtgctcgatttagatctactgacaacgacacaaggggaggaactgctcagttaggacccagagggaaccatggaagcccagctcagcttctcttcctcctgctactctggctccagattccacggagaagttgtgttgacacagtctccagccacctgtcttgctcgagggaangccacctctctgcgagggccagtcagagtcgttaggacgtctaccgtagcctaggtactcaaacgacgtaaccgtcggaccaggtcctacccgaggtccttccgtacacttaccgtagtgaacgttggacctaacgtacccgaaacggtacgggaccctaacgtcggaccctaacgttacccgaaggtacccgttaaacggtttaccgaagggtacgggtaccaaggggttcggggtaaccgtaggggaaacctaagggttacccttttaccggaaacccttttccgtaaaccgaaccctaacgttacccggaaacggacccgtaaacggtaacccgtttaaacgggaaccgttaacccgttaagggtaaaacggttttactttttacgggaaccgttttaaagggttttttaacctaacggttcggttaacccgaaggtaccgtaacgggtaccgtttaacggacccttaaaccggggttcccggggaacccctttaacgggggtaaccccgtttaccggggaaaacccggtaacgggtaaaaccgttaaacgggtaccggaacggtaacgttaccggaaacgggtaaccgttaaccgttacggttacggaccgttacgacccttaacgtacgttccgttaccgg

SEQ ID NO: 151943 - DNA, 657 bp, Homo sapiens
  misc_feature: GYAE6OF01AFLZI.9.6.A06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacgacacgaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangccaccctctcctgcagggccagtcagagtcttaggagtcttccgttagcctggtactcaacagaaacctggccaggcctcccgaggtcctccgtcaattcctagtcgacttgactacgtcccgaaacgtcgggaccctagttcgggcctaacgtccccgagtcccgtaggttcaggtcggactagggttcgggtcgtagggactaggtaccttcgacctcctaccgacctatcacgcaggtacctaggacgtccgtagtaacgttatttcgacttagtttacttaccgtgtactacggtctacggtcgtaacgccgtaaccgggtccggtcccgttacgggtaccgttcccgggaaccgtaacggggtaaccctaaacgggtcgaaaccgtacgtaccggaacggtccgtaaccggtggtacggcctaggaccctacgtagtccttacgg

SEQ ID NO: 151944 - DNA, 617 bp, Homo sapiens
  misc_feature: GYAE6OF01CW62A.9.6.A06.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagtgatacgtctcacgaccggtgctcgatttagatctactgacaacacacgaagggggaggaactgctcagttaggacccagagggaaccatggaagccccagctcagcttctcttcctcctgctactctggcctcccagacttccgaccggagaagttgtgttgacacagtctccagcccaccctgtctttgtcctacgaaggggaaancgcccaccctctcctgcgagggccagtcagagtctaggntctcctagctggtactacaacagaaccgtggaccaggcctacccgaggtcctcctacatctagngtatcgactactacccgaaggacggccagtcggctacctcccgacgtaccgtacggttacgaggtcggacgtagggtgggtacgtagggacctagtacctcgactctacacntcagnacgacgtagacgtacgtagtaatgtttacgagttagtttactagtcgtacagtacaggtcgtagacgaacggttcggaaccgtcgggtaccggtacggaaccggaacgggtaaccgaacggtgaacgtacgaacggaagtccggaacgttcggacggtacacgtacgacccttagtcccgttacg

SEQ ID NO: 151945 - DNA, 736 bp, Homo sapiens
  misc_feature: GYAE6OF01B3OKQ.9.6.A06.1.454.CMB.1.raw
  modified_base (224)..(224): a, c, t, g, unknown or other
  misc_feature (224)..(224): n is a, c, g, or t
tcagtgatacgtctcacgaccggtgctcgatttagatctactgacaacacgacgaagggggacggaactcgcgtctagttagggaccctagagggtaaccatggaacgccccagctacaggcttctctttcctccctgctactcgtggctcccagtattcctaccggagaagttgtgtttagacacagtctccagccacctgtctttgtctccgaggggaaagngccaccctctcctgccgagggccagtcagacgtctagggctctcttagcctaggtactcaacagaaacctggccaggcctccgaggtcctccgtcactctatgagtgcctagtccgaacgtcgggacccagtcggtactagtccccgaggccctaaggttcaggtcggactaggttcgggtcgtacgggaacctcggtacctttcgaccgttcctaccaaccgtattccgaagaccaacggtacctaagggaaccgtaccgttaagtaaaacgtttcgtttttacgaacgtttaaggttttaactttaacggttcgttaaccaggtccgtaaacgggtccggttaacggacccgttaaacggttcccggggtacccggttaaccgggtaccgtttaccggggaacccggaaacggggtaaacccgtaaagggtacgggaaccgttacgtacgaaaacggtcccggtaaacttgggccggttactacgtaacgtaccctagttcccgttaccg

SEQ ID NO: 151946 - DNA, 734 bp, Homo sapiens
  misc_feature: GYAE6OF01CWU8W.9.6.A06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacgaagggggaggaactgctcagttaggacccagagggaaccatggaagccccagctcagcttctcttcctcctgctactctggctcccagacttccaccggagtaagttgtgttgacacagtctccagccacctgtcttgtctccgaggggaanacgcccacctctcctgcgacgggcctagtcgagacgttcgtaggacgtccttccgttagccttaggtactaccgaaacgaacgtaaaccgtggacccacggtcccacccgaggtcccttcctacattctaagtcgtatcgacaacgtaccgaacgtacgggcctaacgtcggacctaccgtaccccgacggtaccgtaggttaccgagggttaccgggacgtacggggttcgggtacgtacggggactaacgtcctttaccaccttactacccgaaccttgtaaccggactaccgaagtaaccgttaacggacgttaaccgtaaggtaaacgtttgtttacgtacgtttaacgttttaactacgtcgtacgacgtaccgagtacgtacgtactaaccgggtcgtaacccggttacgggtaccgttaccgggaaccgtaaaacggggaacctaacgggtacggtaacaacgttacggaaacgtccggtaacggttcggtgtaccggtacaccgtactgttccgttaaccg

SEQ ID NO: 151947 - DNA, 831 bp, Homo sapiens
  misc_feature: GYAE6OF01AD4TY.9.6.A06.1.454.CMB.1.raw
tcagtgatacgtctcacgaccggtgctcgatttagatctactgacaacacacgaagggggaggaactgctcagttaggacccagagggaaccatggaagccccagctcagcttctcttcctcctgctactctggctcccagacttccaccggagaagttgtgttgacacagtcctccagccctacccttgtctttgtcctaccgaaggggaaacacgccccaccctctccctggcgaggggcccaagtccgagtagttcgttaggactcctaccttagccttaggtaactaccaaaccgacgtaaaacccgtggacccaagggcccttacccgaggtccctcccgtacaatcctatggatcgcctaactcccgaaacgtacggggccctacgtggaccctaacgtcccccgaagtcccgtaggttccgaaggtcggacgtacggggtcggggttaccggtacggggtaacctaacggttacccttaccgtaacccttccgtaacccaacccgtaacgttaccgaacggaccgtaacggtaaccgttacggtaacgtacccgtttaaggtaaaccgtttgttttaccggaacttttaacggttttaactaaccggttgtaccgacggtacccgtaagggtaccgttaaccggaccgtaaccgggttccgggtaccccggttacccgggtaaccggttacccgggaaacccggtaaacccgggtaacccgttaaaacgggcgggtaaaccctacggttaacccggtaaggacccggttaaccggttgggtaaccgggacccttacggaacctacccgttcgtcgtttaacccg

SEQ ID NO: 151948 - DNA, 787 bp, Homo sapiens
  misc_feature: GYAE6OF01EXNHT.9.6.A06.1.454.CMB.1.raw
tcagtgatacgtctcacgaccggtgctcgatttagatctactgacaacacataagggggaggaactgctcagttaggacccagagggaaccatggaagccccagctcagcttctcttcctctgctactctggctcccagacttccaccggagaagttgtgttgacacagtctccagcctaccctgttctttgtctaccgaaggggaacacgccctacccgtctcctgcgacgggccagtcgagtacgtcttaggacgtcctccgttacgccgttaggtactaccgaaacgaacgtaaaccgtcggacccgacggtccctacccgaggtcccttacctactacgttcttagtcgtattcggacctactacccgaaccggtccgggacccaggtcggaccacgtaccccgacggtaccgtacggttaccgaggtcggacggtacgggttcgggtacggtacgggaaccgtacgtaccttacccgtaccgttccctaccaccgtactacgacgaccgtaacgacgtaacgacgtaccgttaagtaacgtttagttttacgtacgtttaagtttacgttacgttcgtactaacggtacgtacggtacgtaaccgtacgtaccgggttccggtacccggttaaccggggttaacccggttaccggggaaaccgggtaaaccggtaaaccggttaaacgggtacgggtaacccgtaaggtaaccggaaacgggtaaccggtaacgttcgggaccggtcctaacccggaccgtaaccttccgttcgttaacccg

SEQ ID NO: 151949 - DNA, 820 bp, Homo sapiens
  misc_feature: GYAE6OF01DZAWC.9.6.A06.1.454.CMB.1.raw
tcagtgatacgtctcacgaccggtgctcgatttagatctactgacaacacacgaagggggagaactgctcagttaggacccagagggaaccatggaacgccccagctcagcttctccttcctcctgcctactctggcctccagtacttaccgaccgggagtaaggttcgttgttagacactagtcctccacgtccctaccgttgttcgtttgtccgtacggaagggaaaacgccgtaccctaccctccgtccgtgaccgacggacccgtagccgtagtacgttacggttaacggtcctcgttaccgtacgtaccgtaggtaacttaaccgaaacgtaaccgaaaccgtcggaaccgaccggtacccgtacccggaccggttacccttaccctacgtacttaccgttagtaacgttcgtaaccgaacctaccgtaaccggaaccggtaccggtaccgtacgacggtacccaccccgttaacgaccgtacgtaccggggttacgacggggtcgccggttaggggtccggttaacggaacgggcctaaaggtcccttaaccgtccttacccgaccttacccgtaagaccgtaacgtaccgaacgttaacggaacgtaaccgtacggtaacgttaacgtttacgttacttacggtttacgtttaacgtcgttacgagttacggctacggaccgtacgtaccgtacgtaccggtccggtaacggtccggtacggaacccggtaaacggacgaaacggttacgaacgtacgaacggttacacggtacgtacgtacgtaccgtacgactaacgtccgtgtttacccg

SEQ ID NO: 151950 - DNA, 738 bp, Homo sapiens
  misc_feature: GYAE6OF01EEIX0.9.6.A06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacgaagggggaggaactgctcagttaggacccagagggaaccatggaagccccagctcagcttctcttcctcctgctactctggcctccagacttccaccggagaagttgtgttgacacagtctccagccacctgtctttgtctcgaggggaancgccacctctcctgcgacgggccagtcagtagttcgttaggacgtccttaccgttagccgtaggtactacaaacgaacgtaaaccgtcggaccaggtccctacccgacgggtccttacccttactaacgtttactaacgttaggaacttacggacctaacgtacccgaaacgggaccgggaccctaacgtcggaccaccgttaccccgagtacccgtaggttacagggtcggacgtagggtcgggtacgtacggggaactacgtaccgttcacgtcctaccaaccgtatacgacgtacgacgtaacgtagacgtactaggtaagttctttacgacttttagtttaacttacgtcgtacgtacgacgtacgtacggtaacgtaccgtaacggtcccggtaacggttccggtacgggttaccgggaaccggtaaaccgggaaccgtaaagggtaccggtaactacggtaacggtaacggtcggtaaaccggttggtaccggtacgttacgacccgttaacctacgttcgttaccgg

SEQ ID NO: 151951 - DNA, 704 bp, Homo sapiens
  misc_feature: GYAE6OF01BDT5R.9.6.A06.1.454.CMB.1.raw
  modified_base (126)..(126): a, c, t, g, unknown or other
  misc_feature (126)..(126): n is a, c, g, or t
  modified_base (211)..(211): a, c, t, g, unknown or other
  misc_feature (211)..(211): n is a, c, g, or t
  modified_base (563)..(563): a, c, t, g, unknown or other
  misc_feature (563)..(563): n is a, c, g, or t
tcagtgatacgtctcacgaccggtgctcgatttagatctactgacaacacaccaagggggaggaactgctcagttaggacccagaggggaaccatggaagccccagctcagcttctcttcctcctnctactctggctcccagattccaccggataagttgtgttgacacagtcctccagcccaccctgttctttgtcctccgaaggggaanacgcccaccctctcctgcgagggccagtctagagttcttagggacgtcctccttacggcctaggtactaccaacaacgaaaccgtggaccgacggccctcccaggtcctccctctatacctaatgactcgcctaactacccgaacggtccgggccctacgtcggtccaccgtaccccgagtacccgtggttacgaggttcggacgtagggttggggtccgtagggacctacggtacctttccgaccttccgaccgacctatcacgtaccgagtacgtagacgtccttaagaggttacttttagacgtttagttttaattaccgtgtacgtacgaccgtaggaccggtttaanaccccgtaaaggttcccgggcccgttacggggtaaccgttacccggggaaaccggaaccgggtaaacggaacgttacgggaactaccgtaacgtaacggtcgtacgtggtaacggccttaggacctacgttgtccgttacc

SEQ ID NO: 151952 - DNA, 749 bp, Homo sapiens
  misc_feature: GYAE6OF01C6SFW.9.6.A06.1.454.CMB.1.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
  modified_base (590)..(590): a, c, t, g, unknown or other
  misc_feature (590)..(590): n is a, c, g, or t
  modified_base (718)..(718): a, c, t, g, unknown or other
  misc_feature (718)..(718): n is a, c, g, or t
  modified_base (729)..(729): a, c, t, g, unknown or other
  misc_feature (729)..(729): n is a, c, g, or t
tcagtgatacgtctcacgaccggtgctcgatttagatctactgacaacacacgaagggggaggactgctcagttaggacccagaggaaccatggaacgccccagctcagcttctccttcctcctgcctactctggcctaccagcttccgacggagtagttgtgttgacacgagtcctcgacgccncctgttcttcgctccggaagggaanaccgcccaccgtcctccgtgcgacggccagtcgagtcgtacgtaggctccgttactcggtactggtactaccgtaacgacgaaccgtcggaccgacggtccctaccgcggtcccttccgtacactttctacgtcgtagttccacctacgtaacccgaaccgggtaccgggtacccacggtccggacctaaccccgtcccgaccggttacggtacggttaccgtagggtcggtaacggtcggggttcgggtccggaacggtacgtaccgtaacccgttcgaaccttcccgtaacccactactaaccgtaccgcgtaacgtacgtaccggagttaccccgtaaggtaagttttcgtttacgtttacgttttaaccggtttanacggtttcacggacggttacgtacgtaccggaacgtacggttccgttacgggcccgggttccgtaacggttaccgacggtaaccgaacggtaaacgcgtaaacgcgtaccgaaaggcgtacgggttcncggtactcggntttaaccgtgttcgttaccg

SEQ ID NO: 151953 - DNA, 729 bp, Homo sapiens
  misc_feature: GYAE6OF01BC26O.9.6.A06.1.454.CMB.1.raw
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
tcagtgatacgtctcacgaccggtgctcgatttagatctactgacaacaccacaagggggaggaactgctcagttaggacccaggagggaaccatggaacgccccagctcagcttctcttcctcctgctacctcgtcggctcccagacttaccgaccggagtaagttgtgttgacacagtctccagccaccctgtctttgtctcgaggggaaancgccaccctctcctgcagggccagtcagngtacttaggacgcttccttagcctggtatcaacagaacctggaccaggcctccaggtctcctcatctattgactcgcactacctaacgtacgggacctacgtcggacctacgtccccgaacgtccccgtagggtttccacgggttcgggaccgtacgggttacggggtctacgggggtaactacggtaccctttacaaccttcttaaccgaccctaactccgaacgaccgaacgtaaccgttacggaacggtacccgttaggtaaacgttttaccgttttaccggacgtttaacgtttttaacgtacgtccgttaccgacgggtaaccacgggtcccgttaacgccgtaaccgtccgggtacccctttacggggaacccggtttcgggaaacccgtaaacgggtaaccaaacggttacggacctacgtaccggaaggtacccgaaacggtcgtacggtactaccggacctacctacgttgttcccg

SEQ ID NO: 151954 - DNA, 864 bp, Homo sapiens
  misc_feature: GYAE6OF01CZKOV.9.6.A06.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (427)..(427): a, c, t, g, unknown or other
  misc_feature (427)..(427): n is a, c, g, or t
tcagtgatacgtctcacgaccggtgctcgatttagatctactgacaacacacgaagggggagaactgctcagttaggacccaggagggaaccagtggaacgccccagctcagtcttcctcttccctctcgctactcgtggtcctcccagtacttccgaaccgggagtaagttgttgtgacacgatcctccacggaccctccttnttcgtttcgtccacggaaggggaanacgtcccctaccctccttccgngacgacgggacctagtccgtaaggtacgtacgttaaggtccgtaccttccgtacgtccgtacggtaataccgaaacgtaacgtaaaccgtcggacccgtacgggtaccctacccgaggtcctaccctgtaactcgttacagtcaccgtacactaccggacgaccggtccgtaacgngtacccaccgtccgtaccgaccgtacggttgacggggtggacgtaccgggttcggcggggtaacgtacgtaactttccaacccggttctaccccggtaaccttaaacgtccgtacgtaaccgagtaaccggtaacggtacgtaacgtacgtaacggttaacgtttacgttcgtttaacgtttaacgttacttaccggtttagaccgtacggaacggttaccggtacggaacccttacggaacccgggttccggttaccggtacccgggggttaacttaacccccggggaaacgggtaaaccggtaaacggtaaccgggaaaccccgtaacggtaaccgttaacccgggtaaaccggtacccggttaaacgggtcgggttaaaacgtccccgggtaacccggttacctaacccgggttaccgttcgggtttaaccccg

SEQ ID NO: 151955 - DNA, 715 bp, Homo sapiens
  misc_feature: GYAE6OF01D41ZX.9.6.A06.1.454.CMB.1.raw
  modified_base (171)..(171): a, c, t, g, unknown or other
  misc_feature (171)..(171): n is a, c, g, or t
  modified_base (491)..(491): a, c, t, g, unknown or other
  misc_feature (491)..(491): n is a, c, g, or t
  modified_base (704)..(704): a, c, t, g, unknown or other
  misc_feature (704)..(704): n is a, c, g, or t
tcagtgatacgtctcacgaccggtgctcgatttagatctactgacaacacacgaagggggaggaactgctcagttaggacccagagggaaccatggaagccccagctcagcttctcttccctctgctactctggcctcccagacttccaccggagaagttgtgttagacanagtcctcacgcccacccgttgttcctttgtcctaccggaaggggaaaacgacgccctaccctcgtacctggccgtacggggcctagtccaaggtacgttccgttaacgggacgtcctaccgttacgccgttaggtaactacctaaacgacggtaaaacccgtcgggccgaacgggtcctacccgacggtccttacctccagttactatacgagtcgacacgtacccaaaggaccggaccagtcgacacctcccgagtccgagttcaggtcggcgtaggtcgggtagaggacctacgtactcctactactccaacgtactnaacgtacaacgtacgaagacgtaccgtaggtaaatttcgtttacggtacttaaacggtttacgtaaccgtggtaactacgtcgtaacgtcggtactacggaaccgtttccggaccggttcgtaccggttaccgggaacggaaaccgttaaccgggaaagttacggacgtactaacggacgtacgtaacggtgtacggtactacgaccacgttntacggttaccg

SEQ ID NO: 151956 - DNA, 764 bp, Homo sapiens
  misc_feature: GYAE6OF01EQW0E.9.6.A06.1.454.CMB.1.raw
  modified_base (606)..(606): a, c, t, g, unknown or other
  misc_feature (606)..(606): n is a, c, g, or t
  modified_base (740)..(740): a, c, t, g, unknown or other
  misc_feature (740)..(740): n is a, c, g, or t
tcagtgatacgtctcacgaccggtgctcgatttagatctactgacaacacacgaagggggagaactgctcagttaggacccagagggaaccatggaagccccagctcagcttctcttccctcctgctactctggcctcccagacttcccgaccggagtaagtttgtgttcgacactagtcctccacgccctaccctgttctttgtctccggaaggggaacacgcccaccctctcctgccgacgggcctagtccagtacgttcgttaagggacgtccttaccgttagtccgttaggttaactaccaaacgtaacggtaaacccgtcgggaccgacgggccctacccggacgtcccttccgtacactttctagtcgtattacggcctacgtacccgaacggtccgggaccctacggtcggaccctacccgttccccgaaggacccggttagggttaccgtacggggtcggaccggttagggtccggggttaccggtaggggaaccttacggtaaccttcctaaccgtcccaccacctagtacgacgacgtagtacctaggaccgtacgtaagtaagtttctttaccgtagtttaagttttctacggtntaaccgtacgacgtccggtacgtaccgaccgtaccggtttccgggacccgttccgggtaccgttaaccgggaaccggtaacgggttaaacgacggtacgaactacggtacgacgtacggtcgttcggggtaccnccgtagaacccttctgttccgtac

SEQ ID NO: 151957 - DNA, 1127 bp, Homo sapiens
  misc_feature: GYAE6OF01BVR0Q.9.6.A06.1.454.CMB.1.raw
tcagtgatacgtctcacgaccggtgctcgatttagatctactgacaacacacgaagggggaggaactgctcagttaggacccaggagggaaccagtggaacgccccagctcagcttctcttcctcctgctactctggcctcccagacttccgaccggagtaagttgtgttgacactagtctccagccctaccctgttcctttgttccgtaccgaagggggaaacgcgccccgtaccccttcctcccgtagcccgacgggcccaggtcgaggtacgttcgttacgggacgtccttacccgttaggtccgttaggtaactaaccgaaaccgaaccggtaaacccgtcggacccgacggtaccccgtcccgtaacgggtcccccttcccgttactaacttacccttaggttcgtaacgtaccgtaccgtaacccgtaaccccgtaaaccggtacccggggtacccctaccggtaccgggtacccctaacccgttaccccgaacccggtacccggtaccgggtttaccgtagggtcggtaccgggtaggtttccggggtacggtacgggtaccgtaacgtaccctttacccgtacccgttacccgtaccctaaccgtaaccgttaccgtaacggtacccggttaaaccggtaacggttaaccgggtaacccggtttaaccggttaacgggttaaaccggttttttaacggttttaccgggtttaaacggtttttaacccgtttttaacggttttaacggttaccgtttaacccggtacgggttaacccggtacgggtttaacccggttaaaccggtaacccgggttaaccccggggttacccgggggtttaccccgggtttaacccggggggtttaccccggggtaaaccccccgggggtaacccgggttaaaaaaaccccggggggtaaccccggggttaaaaacgggggttaaacccggggttaaacccgttaaaccgggttaaaacccgggggaaaaacccggggttacccgggtttaaaaacccggggttttccccgggggtttaaacccggggtacccgtttacccggtaaacccccccggttttaaccccggttaaaccggtttcccggttttttaacccccggg

SEQ ID NO: 151958 - DNA, 710 bp, Homo sapiens
  misc_feature: GYAE6OF01AD3YO.9.6.A06.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
tcagtgatacgtctcacgaccggtgctcgatttagatctactgacaacgacacaagggggagaactgctcagttaggacccgagagggaaccatggaagccccagctcagcttctcttcctcctgctacctctggctcccagacttccaccggagaacgttgtgttgacacagtctccagccacctgtctttgctccgaggggaaancgccaccctntcctgcagggccagtcagagtcttaggatccttccttagcctggtatcaacagaaacctggccaggcctccaggctcctcatctatgatcgacactccaacgcgggaccacgtcggactacgtccccaagtcccgtaagggtttcaggttcggaccgtagggttcgggtacgttacgggaacgtacgtaacctttccaacgttcctaccaccctatccaagtaccaagtacctaaggactaccgtaggtaaacgttagtttttacgacctttaagttttacgttaacgtggttaccctaaggtaccgtacgggaccgtttaagaacccgttaacgttccgggtaccccgttacgggtaaccggtttaccccgggaaccggtaaccggggtaacccgtaaaggtaaccggaaccgtaacgttaccggaaaacggtccgttaaaaccggttggtaccgggtacctacggtacccaacccttaggttcccttacgg

SEQ ID NO: 151959 - DNA, 769 bp, Homo sapiens
  misc_feature: GYAE6OF01DN7WV.9.6.A06.1.454.CMB.1.raw
  modified_base (227)..(227): a, c, t, g, unknown or other
  misc_feature (227)..(227): n is a, c, g, or t
  modified_base (470)..(470): a, c, t, g, unknown or other
  misc_feature (470)..(470): n is a, c, g, or t
  modified_base (588)..(588): a, c, t, g, unknown or other
  misc_feature (588)..(588): n is a, c, g, or t
tcagtgatacgtctcacgaccggtgctcgatttagatctactgacaacacacgaagggggaggaactgctcagttaggacccagagggaaccagtggaacgccccagctcagcttctcttcctcctgctactcgtggcctcccagtacttccgaccggagtaagttgtgttgacacagtcctccagaccctcccttgttctttcgtcctacggaaggggaaacaccnccctacccctcgtcctacggcgacgggccctaagtccgaagtagttccgtaggacgtccttccgttacggccgttacgtacgtaccaaacggtaaccgtaaaccgtcggccgaccggtaccctccgacggtccctaccgtactacgttcgtaactggtactcaccgacctaccggaacgtccgggacctacgtacggtactaccccgtaccgtaagtcccgtaggttacccggagggtaccgngttaccggggttgggtaccggtaagggacctacgttaccgtactaaccgttcctaacgaaccttcgtaacgccgacaacgttacgagaacctacggttagtaacgtttgtttaccttnttaacgtttctacgttctagactagtacgtcggtaactccgtacgtccggtacgttaccgggttaccggtacggtaaacccggaacgggttaaccgaggtaccgtaaacgtccgtaaacgtacgtaaaccggtcgacggttaccgtcggaaaccgcccgttaacgttgtaccccggtttgg

SEQ ID NO: 151960 - DNA, 663 bp, Homo sapiens
  misc_feature: GYAE6OF01EWMWP.9.6.A06.1.454.CMB.1.raw
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (537)..(537): a, c, t, g, unknown or other
  misc_feature (537)..(537): n is a, c, g, or t
  modified_base (640)..(640): a, c, t, g, unknown or other
  misc_feature (640)..(640): n is a, c, g, or t
tcagtgatacgtctcacgaccggtgctcgattttagatctactgacaacgacgacaagggggaggaactgctcagttagggacccagagggaaccatggaagccccagctcagcttctcttcctcctgctactcctaggctcccagatttccaccgganaagttgngttgacacagtctccagccacctgtctttgtctaccaaggggaaacncgccaccctctcctgcagggccagtcagagtcttaaggganctaccgtttagcctggtacttcgaaacagaaacctggaccaggctacccaggccttctacattccaatagatcggcctatacccgaaactaggggacccaacttcggggccaacttacccccgaagggcccctaaagggtttccgaagttgggccctaaggtccgggtaactggggaacaggttaaccttcgaaccttctcaacctntcaaccggtnaacggacttaaggacgaccgttagaagtattttacggacttagtttaactttaagtaggttcaganacgtacggttaagcccgtaaagttcggacccgtcgaacggtttcgcggaaacggtacgaaacgttaggaaccgtaagacgaaggcctaaaacggtcggttacncgttagaccctacacgtcttacg

SEQ ID NO: 151961 - DNA, 919 bp, Homo sapiens
  misc_feature: GYAE6OF01AZ123.9.6.A06.1.454.CMB.1.raw
  modified_base (215)..(215): a, c, t, g, unknown or other
  misc_feature (215)..(215): n is a, c, g, or t
tcagtgatacgtctcacgaccggtgctcgatttagatctactgacaacacacgaagggggaggaactgctcagttaggacccgagagggaaccatggaagccccagctcagcttctcttcctcctgctactctggcctcccagacttccgacggagtaaggttgtgttgacactagtcctccagcccacctgttcctttgcctccgaggggaacncgcccaccctcgtcctgccgacgggtccagtccaggtacgttacgttacggacgtccttaccgttacggtccgtttaggtaactaccgaaaccgtaaacgtaaaacccgtcgggtaacccgaacgggtcccctacccggtaagggtcccctttacccctactacgttaccgtaaagtcggaccgtgaaccctaccgtaacccggaaccggaccgggtaccctacggttacggaccctaaccctcccgacgggtaccccggtaaggtttaccggacggggttcgaaccgggtacggggttaccgggtcgggtacggggaacctaacggttcccttacgtaccggtaccctaaccacccgttaacaaccgtaccggtacgtaacggtaaccgttaacgtaacccgttaccggttaaacggttaaggttttaccctttttaagggacctttttaaacgttttaaccgttacgttacgggtaacccgtacgggtaacttaacgggttaccggtaaccggtaacccggttaaccgtcccggggttaaccccggttacggggttaacccggttacccggtaaaccggtaaacccggttaaccggtaacggtaaccggggtaaccctaaccggtaaccggtaacgggtacccgtaaacggtcgggttaccgtaaccggtccctaacccgtacgttccgtttccgttacccg

SEQ ID NO: 151962 - DNA, 844 bp, Homo sapiens
  misc_feature: GYAE6OF01BGFGZ.9.6.A06.1.454.CMB.1.raw
  modified_base (265)..(265): a, c, t, g, unknown or other
  misc_feature (265)..(265): n is a, c, g, or t
  modified_base (486)..(486): a, c, t, g, unknown or other
  misc_feature (486)..(486): n is a, c, g, or t
  modified_base (565)..(565): a, c, t, g, unknown or other
  misc_feature (565)..(565): n is a, c, g, or t
tcagtgatacgtctcacgaccggtgctcgatttagatctactgacaacacgacgaaggggggaggaactgctcagttaggacccagagggaaccagtggaacgccccagctcagtcttacttccttcctacctgtcctactcgtagggtcctacccgagtacttccgaaccgggagtaaggttgtggttacaaccgtacgtactcctaccgacgtccctacccctggtttactttcgtacccgtaccgggaaagggggtaaaacnccggtccccctacccgttaccgttccgcggaccggaccggggtaaccctgggaccgtaaggttcggttaccggttaagggaccgttccgttccgttaaacggccgtttggaaactaccgaaacgtaccggaaaccgtcgggaccgaacgcccttacggacgtccttccgtactacttactagccgtaagtccgaactacgaacccaacgggcggtaccgtntaccggcctacggtaccctagccggtttaggacgtgggtcgagttacgggcggtacgtacggacgttacgtaccctttnaccgttcgtacctagactacgacgagtaacgtaacgacgtacgacgttaacggaacttttattaccgaagtttcgtttaacgtacggagttccgtaacgtaggtacgtcggtttaaccggaacgttacccgggtaccggtaccgggttaccgtacggggttaaacccgggaacggaacgggttaaccggaaaccggttacgtaacggaacccgtacccggaaacggtacggttaccggtacggacggttacccacgttaccggctaccggtttctaccg

SEQ ID NO: 151963 - DNA, 744 bp, Homo sapiens
  misc_feature: GYAE6OF01A3TSM.9.6.A06.1.454.CMB.1.raw
  modified_base (52)..(52): a, c, t, g, unknown or other
  misc_feature (52)..(52): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (487)..(487): a, c, t, g, unknown or other
  misc_feature (487)..(487): n is a, c, g, or t
  modified_base (544)..(544): a, c, t, g, unknown or other
  misc_feature (544)..(544): n is a, c, g, or t
tcagtgatacgtctcacgaccggtgctcgatttagatctactgacaacacanaagggggaggaactgctcagttaggacccagagggaaccatggaagccccagctcagcttctcttcctcctgctactctggctcccagacttccaccggagaagttgtgttgacacagtcctccagcccaccctgttctttgtcctcgaggggaanacgccctacctcctccngcgacgggcctagtcagtagtcgttaggacgtccttccgttacgccgttaggtaactaccaaaccgaacgtaaacccgtcggacccgaacggtcccgttaccccgaaggtccccttaccctacctacctttacgtactcggattcgacctaacgtcccgaaaccggtccgggaccctacgtcggacctaccctacccgacgacccgttaggttaccgacggtgaccgtagggtcgggtcgtacgggactacgtaccttaccnccgtcctaccactaacgtcacgtacgacgtacgagtaccctacggttataacgtttntttacgtacgtttaacgttttacttacgtacgtacgcgttaagtacgtaccgtaacgacgttaccggtcccgggttaaccgtaccgggttaccggtaccgggaacggtaaaccggtacggtaacgtaccggaaatacggtaacgacggtacgttaacggtcgttaccggactacccggtaccacgtttcggttccttccg

SEQ ID NO: 151964 - DNA, 520 bp, Homo sapiens
  misc_feature: GYAE6OF02HX3OR.9.6.A06.1.454.CMB.1.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagtgatacgtctcacgaccggtgctcgatttagatctactgacaacacgacaagggggaggaactgctcagttaggacccagagggaaccatggaagccccagctcagcttctcttcctcctgctactctggctcccagattccaccggagaagttgtgttgactacagtctccagccaccctgtcttgtctccaggggaaangccacctctcctgcagggccagtcagagtcttaggagctccttagcctggtatcaacagaaacctggccaggctccaggctcctcatctatgatggcatccaanagggccactggcatcccagccaggttcagtggcagtgggtactgggacngacttcactctcaccatcagcagactagncctagaagtnttttgcttaagtttattactgtacagcagcgtagccaaacgtggacccgtcggtacgtcgaccgaagggaccaaagtggaacatacgaacgcgaactggtacgcgtgtaccgaccatctacgg

SEQ ID NO: 151965 - DNA, 591 bp, Homo sapiens
  misc_feature: GYAE6OF02FPH2G.9.6.A06.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
  modified_base (432)..(432): a, c, t, g, unknown or other
  misc_feature (432)..(432): n is a, c, g, or t
tcagtgatacgtctcacgaccggtgctcgatttagatctactgacaacacacaaaggggggaggaacgtgctcacgttaggacccagagggaaccatggaagccccagctcgacgcttctcttcctcctgcgtactctggctcccagattccgaccggagaagttggtgttcgacacagtctccagcccacctgtctttacgtctccaggggaaancgccaccctctcctgcagggccaggtcagagtcttaggacnctccttagcctgggtatcaacagaacctggccaggctcccgaggctccgtctatctatgatacgcgatcccaacgacgggccacgtggccagtcccagccaggttccaaggttcggactagggtcggtctggggacagtacgttcgacgtcgtccacgagtcagctagactaggngtacctagaagtacgtttcgctacgtttacttacgtgtacacgctaggcgtacgtactaacgtgtacccgtcggaacgttcggacgtaacgggacctaaggtcgaccgagtaccgaacggtccggaacgtggtacggctagaccgacctagtccgtacg

SEQ ID NO: 151966 - DNA, 599 bp, Homo sapiens
  misc_feature: GYAE6OF02JNK5M.9.6.A06.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (443)..(443): a, c, t, g, unknown or other
  misc_feature (443)..(443): n is a, c, g, or t
tcagtgatacgtctcacgaccggtgctcgatttagatctactgacaacacaccaagggggaggaactgctcagttaggacccagagggaaccatggaagccccagctcagcttctcttcctcctgctactctcggctccagattccaccggagaagttgtgttgacacagtctaccagccaccctgtctttgactccgaggggaaangcccacctctcctgcagggccagtcagtagtcttagganctccttagcctaggtatcaacacgaacctggacctaggcctaccgaggtccttcctcattctagtcgatcgcactaccaacgacgggcctacgtggccactccccgagccctaggttccaggtcggcaggtcgggtcctagggaccaggtaccttcgacttctacacatcacgcagaactagctccgtagaacgttntttcgcttaagttttactaccgtgtcacgtcgacgtctagacctagttcggccgttacgggtccgttccggaaccgtaacgggacctaggtcggaactacgtacgaacggtaccgaacgtcggtacgtacgtccggactaacccgttgaccgttcg

SEQ ID NO: 151967 - DNA, 770 bp, Homo sapiens
  misc_feature: GYAE6OF02FPWP2.9.6.A06.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagtgatacgtctcacgaccggtgctcgatttagatctactgacaacgtacgacaagggggtaggaactgctcagttaggacccaggagggaaccatggaagccccagctcgagcttactctttcctcctgcttactctggctcccagattccaccggagagttgtagttgaccacagtctccagccaccctgtctttgtcctccaggggaacngcccacctctcctcgcagggccagtcagagtctaggcnctcctagcctggtatcgaacacgaaaccgtggaccagggcctcccgagggtcctaccctacattcgtaatggacttcgactactcccgaaacggcggggaccctaacggtcggacctaccgttacccccgaggtacccgtaacgggtttcccaaggggttcgggacctaaccggggttccggggtaccgtcggggtaacctaacgggttccctttacccaccgttccctacccgaaccctaagtaccgtaacggtcctaacggtaaccggtaacgggacccgtaccgtaagggtaaacggttacgtttttacggaaccgtttaaggttttaactttacgtacgttacgacgtacgtaggtaccgtacggacctaaacggtccggtcccgtaccgggtaccggtttacccgggaaccgtaaccgggaccgtaaacgggtcggaaccgtaacgtaccggtaaacggaccggtaacgttacggtacggtccgtacggtaccgaccgttacgttcgttccg

SEQ ID NO: 151968 - DNA, 735 bp, Homo sapiens
  misc_feature: GYAE6OF02F6O2Q.9.6.A06.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
tcagtgatacgtctcacgaccggtgctcgatttagatctactgacaacgacgacgaagggggaggaactgctcagttaggacccagagggaaccatcggaagccccagcgtcagcttctcttcctcctgctactctgctccagattccacggagagttgtgttgacacagtctccagccacctgtctttgctcgagggaangccacctctcctgcagggccagtcagngtctagnctctagcctgtatcacagaacctggccaggcctcccgaggcctcctcatctatgtatgacactaccgaacgacgggccctaacgtcggaccaactccccgacgtaccgtacggtttacgacggttacgggccgttacgggttcggggtccgtaacgggggtacctaacggttacccgtttaccaaccttccgtccctaacccgtacgttccgaacggtacgaacggtaacgtaaggtaccgtaccgttaggttaaacgtttacgttttaggtacttttaaggttttacgtttacgtacgggttactacgtaccgtacggtaccgttaacggtaccgttaaccggttccggtacccggtttaccggggtaacccgtttacccggggaaacccgtaaacggggtaacccgtaacgggtacggtaacgtacggttaaccgaacgggtaccgtaacggttccggtacggaccgttacgacccaccgtttacggtcctttacccg

SEQ ID NO: 151969 - DNA, 649 bp, Homo sapiens
  misc_feature: GYAE6OF02F773G.9.6.A06.1.454.CMB.1.raw
  modified_base (206)..(206): a, c, t, g, unknown or other
  misc_feature (206)..(206): n is a, c, g, or t
  modified_base (325)..(325): a, c, t, g, unknown or other
  misc_feature (325)..(325): n is a, c, g, or t
  modified_base (409)..(409): a, c, t, g, unknown or other
  misc_feature (409)..(409): n is a, c, g, or t
tcagtgatacgtctcacgaccggtgctcgatttagatctactgacaacacaccaagggggaggaactgctcagttaggacccagagggaaccatggaagcccccagctcagcttctcttcctcctgctactctggctcccagattccaccggagaagttgtgttgaccacagtctccagccaccctgtctttgtctccaggggaanagccaccctctcctgcacgggccagtcagagtcttaggagctccttagcctaggtatcaacagaacctggccaggcctacccgaggtcctcccgtcatcctatgatgacatccaaacgnggcccagtcgcactcccagcctaggtcaggtcgctaggtcgggtcgtaggggactacggtaccttccgaccttcgtccaacctntccaagccaagtacttaggacgtccgtaggaacgttgtttacggtactttaagttttaacttcgtaggttaccaggtcctaaggtcccgggtaacgaccgtacccggtcgggtacccgttacggggacccgttaccgggaccgtaacgggaacccgtaaggtccggaactaacgtaccgaacggtcccgtaaaggtcggttacggccgttacggtaccaacccgttactctttaacccgg

SEQ ID NO: 151970 - DNA, 745 bp, Homo sapiens
  misc_feature: GYAE6OF02GBSU9.9.6.A06.1.454.CMB.1.raw
  modified_base (168)..(168): a, c, t, g, unknown or other
  misc_feature (168)..(168): n is a, c, g, or t
  modified_base (205)..(205): a, c, t, g, unknown or other
  misc_feature (205)..(205): n is a, c, g, or t
tcagtgatacgtctcacgaccggtgctcgatttagatctactgacaacgacacgaagggggaggaactgctcagttaggacccagaggaaccatggaagccccagctcagcttctcttcctcctgctactctggctcccagattccaccggagaagttgtgttgacanagtctccagccaccctgtctttgctccgaggggaaancgccacctctcctgcacgggtccagtcagtagtctaaggagcttccgtagccttggtactacaacaacgtaaacctcggaccgaggtcctacccgacggcctcctacactctactgactgaccgactaccgaaccgagggtacccacgttacggacctacggtacccaagtacccgtaaggttaccgtaagtcgggtacgtaacgggttcgggtcgttacggggggaacctacgggttaacccgtttaccaccgttccgttacccgaacccttacaccgttaacgaacccgtagtaacgtaacggtaccgtaccgttaggtaaaccggtttagttttaccggtaacgtttaacgtttttaacgttacgttacgtaccgacgtacgtacggtacggtaaccgtaccgtaacgttacggtacccgttacgggtaacccggttacggtacccggaaaccgggtaaccgaacgggtacgaaccgtacgaacgtaacgaacgttacgtacggtacgtacgtacggacctacgtacgtattaccgg

SEQ ID NO: 151971 - DNA, 908 bp, Homo sapiens
  misc_feature: GYAE6OF02G21IL.9.6.A06.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagtgatacgtctcacgaccggtgctcgatttagatctactgacaacgacacaagggggaggaactgctcagttaggacccagagggaaccatggaagccccagctcagcttctcttcctcctgctactctggctccagacttccacccggagaagttgtcgttacgaccactagtctccgagcccaccctggtcctttgtcctccgaggggtaacncgccaccctctcccgntacgggccagtcagagtcctaggacgccttccgttaacgccgttaggttactaccaaacgtacggtaaacctggccctaacgggtcccttacccgaagggtccccttacccgtacgtaacgtacccttaaggtcgaaacgttccggactaacgtaccgtaaaccgtacggggccctaacgtcgggacctaacgtacccccgtaaggtacccgtacgggttacgaacggttcgggaccttacggggttcgggttccgtagggacctaacgggtaccctttccggaaccttaccgtaaccgtataccccggagtccgaagtacctaagggacccgtacgtaaggtaaccgtttagtttaccgtacgtttacggttttaacgttaacgtcggttaacgttaccggtacgtacggttaacccgggtaacgtaccgaaacgggttaccgggtaacccgttccggggtttaacccggttacccgggggtaaacccggtaaacgggggtaaaacccctttaaggggaaccccgggggttaaactaccggtttacccgggtaaaaccggaaccgggtttaaacccgggttcggttaccgggttaaccccggttacgggttaaccccgtaaccccggtttaacggtttaccccggtttacggtacccccgttttaaccccggg

SEQ ID NO: 151972 - DNA, 794 bp, Homo sapiens
  misc_feature: GYAE6OF02II1A2.9.6.A06.1.454.CMB.1.raw
  modified_base (222)..(222): a, c, t, g, unknown or other
  misc_feature (222)..(222): n is a, c, g, or t
tcagtgatacgtctcacgaccggtgctcgatttagatctactgacaacacacgaagggggaggaactgctcagttaggacccagagggaaccatggaacgccccagctcagcttctcttcctctgctactctggcctccagtcttccgacggagagttgtgttcgaccacgtagtcctcacgccctacccgttgttccttttcgcctaccggaaggggaacncgcccacctctcgtggacgacgggccagtaccgagtacgttcgttaggactccgtcgtttagccgttagtactacaacgaacgtaaccgtcggacctacggcccgtccgaccggtcctcccgtactacgttacctacgtacgtcgttacggactaccgtaaccgaaccgccggttacccgtacggcgaaccgtccctaccccgaggtaccgttaagggtcctacggggcttacgggtacgggttccggggtagttaaccgggtaacctaacgtttaccgttacccgtaaaccgttcccgtaacctaccgttacgaaccgtgggtaaacccaacgtaaaccgttcgggtaaccgtaccgtaagttacgttaccgttttacggttaacgtttcggtttacttaacgtccggttacgtccgtaacgggtacgttaaccggtacgacccggtttacgaccgggttccggttaccggtccggttaacggacccgtaaccggtaacgtaccggtaaggtaccgaacgtaccaacgggtactacggttacggctacgtacctcctacttccgtactacg

SEQ ID NO: 151973 - DNA, 780 bp, Homo sapiens
  misc_feature: GYAE6OF02H6237.9.6.A06.1.454.CMB.1.raw
  modified_base (131)..(131): a, c, t, g, unknown or other
  misc_feature (131)..(131): n is a, c, g, or t
  modified_base (287)..(287): a, c, t, g, unknown or other
  misc_feature (287)..(287): n is a, c, g, or t
tcagtgatacgtctcacgaccggtgctcgatttagatctactgacaacacacgaagggggaggaactgctcagttaggacccagagggaaccatggaacgccccagctcagcttctcttcctcctgctacncgtggcctacccagattcccgaccggagaacggttgtgttagacacagtcctccagcccacccttggttactttcgcctcggaagggaactacgcctaacccgtctctcgacggacggccaggtacgagtcggttacgtaaggcgtcctccgttanccgtagtataccaagacgaaaccgtcggctacggcctaccgagtccctacgtcgtaatcgtagtagcgttacacgtaaccttaaccgaaccggtaccggtacccgacggtaacccgacgttaaccctccccggaacgttaccgtacggttacgaaggtccggtcggtaaggggttaccggcggttaacgggaccttaacgtcccgttacacgttccaaccgttcacttacgacgtacctagaacgtaccgtaggtcgtaagtaaccgtttattcgtaccggtttaaagttttacctacgttaacgtcgtagtaccggcggttaaacgtaccggaacctccggttaaccggtccgttacgtaaacccggtcgtaccggggaaaccgttaaggaccggtacgggttaaacccgaacgttaaaccggaacggtaacccgacgggttaccggtgggaacccggttaacgtacccgggttacacggttaaccttcggg

SEQ ID NO: 151974 - DNA, 662 bp, Homo sapiens
  misc_feature: GYAE6OF02I1PPB.9.6.A06.1.454.CMB.1.raw
  modified_base (133)..(133): a, c, t, g, unknown or other
  misc_feature (133)..(133): n is a, c, g, or t
  modified_base (171)..(171): a, c, t, g, unknown or other
  misc_feature (171)..(171): n is a, c, g, or t
  modified_base (240)..(240): a, c, t, g, unknown or other
  misc_feature (240)..(240): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagtgatacgtctcacgaccggtgctcgatttagatctactgacgaacacacgaagggggagaactgctcagttaggacccagacgggaaccatggaacgccccagctcagcttctcttcctcctgctactntggcctccagcttccgacggagtagttgtcgttgaccncgacgtctcacgcccaccttgtcctttgctacgaagggaacgccacctgtcctgcaggcctgtcagctntaggctctcttagctggtactcaacacgaaccgtcgaccgacggacctccgacggtctccctactactctagtgactcgcactaccgaacgtacgggccacgtggccacctccacgacgtacgtnacggtgacgtggtggtcgtggacncgtactcctactccgtactacanccgaagtccaanacgtacgaccgttacgtagtaacgttacttctacgttacttttattacgtgtacgacgtaccggtacgttcgtaccgtaacggtcgaaccgggtcgttacccggggtcgttaaacccgggaacccggtaaacgggtaccgtaacgtcggtacccgtaattaacccggaacggttacccggaagtttttacgggccgtaccgggttacaaccccggtacggttacgttcctttaaccgg

SEQ ID NO: 151975 - DNA, 701 bp, Homo sapiens
  misc_feature: GYAE6OF02ITK4M.9.6.A06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacgaagggggaggaactgctcagttaggacccagagggaaccatggaagccccagctcagcttctcttcctcctgctactctggcctccagattccaccggagaagttgtgttgacacagtctccagccacctgtcttgtctccgagggaaanacgccaccctctccgtgcgaggccagtcagagttacgttaggacgtccttccttagccttaggtaactaccaaacgaacgtaaaccgtgggaccctaacgggcctaccccgaaggcccttcccgtactaacttccttaagttacgacttcgacctaactaacccgaaaacgaccgggccctacggttcggaccgtaacctaccccgacgtaccgtacggttcgtaggtacggcgtaagggtcgggtacgtagggaactacgtaacgttccaacgtcctaccgaccactacacgacaagtactagacgacgtaggtaattagtttagactttaagtttacgttactacgttacagacgtagtacgtacgactaacggtcggtaccgttacgggtaacggtaccggaaccggtaacggtaaaccgtaggtacggaacctaagtacgaacggtaacgtaacgtagggttcgaacgtacgtaccgaccgtacgttgttaccg

SEQ ID NO: 151976 - DNA, 122 bp, Homo sapiens
  misc_feature: GYAE6OF01D9TCN.2.41.D08.1.454.CMB.1.raw
tcagacgctcgacacacgaccggtgctcgatttagtcacgcgagaaagggaaggggctggccctgacgtgttctgttcccaccctcctcgtcgagcgtctgagcggctggcaaggcgcatag

SEQ ID NO: 151977 - DNA, 123 bp, Homo sapiens
  misc_feature: GYAE6OF01BX3W2.2.41.D08.1.454.CMB.1.raw
  modified_base (123)..(123): a, c, t, g, unknown or other
  misc_feature (123)..(123): n is a, c, g, or t
tcagacgctcgacacacgaccggtgctcgatttagtcacgcgagaaagggaagggctggccctggacgtgtttctgttcccacctcctcgtcgagcgtctgagcggctggcaaggcgcatagn

SEQ ID NO: 151978 - DNA, 144 bp, Homo sapiens
  misc_feature: GYAE6OF01C51RG.2.41.D08.1.454.CMB.1.raw
  modified_base (126)..(144): a, c, t, g, unknown or other
  misc_feature (126)..(144): n is a, c, g, or t
tcagacgctcgacacacgaccggtgctcgatttagtcacgcgagaaagggaaaggggctggccctgacgtgttcctgttcccgcctcctctgtcgagcgtctgagcgggctggcaaggcgcatagnnnnnnnnnnnnnnnnnnn

SEQ ID NO: 151979 - DNA, 127 bp, Homo sapiens
  misc_feature: GYAE6OF01BW5RT.2.41.D08.1.454.CMB.1.raw
  modified_base (127)..(127): a, c, t, g, unknown or other
  misc_feature (127)..(127): n is a, c, g, or t
tcagacgctcgacacacgaccggtgctcgatttagtcacgcgagaaagggaaaggggctggccctgacgtgtttctgttcccaccctcctctgtcgagcgtctgagcgggctggcaaggcgcatagn

SEQ ID NO: 151980 - DNA, 212 bp, Homo sapiens
  misc_feature: GYAE6OF01DSHAH.2.41.D08.1.454.CMB.1.raw
  modified_base (209)..(212): a, c, t, g, unknown or other
  misc_feature (209)..(212): n is a, c, g, or t
tcagacgctcgacacacgaccggtgctcgatttagtcacgcgagaaagggaaagggtcacgcgagaaagggaaagggcagcccgagaaccacaggtgtacaccctgcccccatcccgggatgagctgaccaagaaccaggtcagcctgacctgcctggtcaaggactacttcctgtcgagcgtctgagcgggctggcaaggcgcatagnnnn

SEQ ID NO: 151981 - DNA, 180 bp, Homo sapiens
  misc_feature: GYAE6OF01DWF48.2.41.D08.1.454.CMB.1.raw
  modified_base (138)..(138): a, c, t, g, unknown or other
  misc_feature (138)..(138): n is a, c, g, or t
  modified_base (140)..(180): a, c, t, g, unknown or other
  misc_feature (140)..(180): n is a, c, g, or t
tcagacgctcgacacacgaccggtgctcgatttagtcacgcgagaaagggaaagggggtcgtggcaaggccgcatagctgcctggtcaaggactacttcctggtccgagcgtctgagcgggctggcaaggcgcatagncnnnnnnnnnnnnnnnnnnnnnnnnnnnnnnnnnnnnnnnnn

SEQ ID NO: 151982 - DNA, 125 bp, Homo sapiens
  misc_feature: GYAE6OF01EWIUM.2.41.D08.1.454.CMB.1.raw
  modified_base (105)..(105): a, c, t, g, unknown or other
  misc_feature (105)..(105): n is a, c, g, or t
tcagacgctcgacacacgaccggtgctcgatttagtcacgcgagaaagggaaaggggctggccctgacgtgtttctgttcccaccctcctctgtcagcgtctgancgggctggcaaggcgcatag

SEQ ID NO: 151983 - DNA, 126 bp, Homo sapiens
  misc_feature: GYAE6OF01CYLKX.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaggggctggccctgacgtgtttctgttcccgccctcctctgtcgagcgtctgagcgggctggcaaggcgcatagn

SEQ ID NO: 151984 - DNA, 126 bp, Homo sapiens
  misc_feature: GYAE6OF01C22E9.2.41.D08.1.454.CMB.1.raw
tcagacgctcgacacacgaccggtgctcgatttagtcacgcgagaaagggaaaggggctggccctgacgtgtttctgttcccgccctcctctgtcgagcgtctgagcgggctggcaaggcgcatag

SEQ ID NO: 151985 - DNA, 127 bp, Homo sapiens
  misc_feature: GYAE6OF01DBUBR.2.41.D08.1.454.CMB.1.raw
  modified_base (127)..(127): a, c, t, g, unknown or other
  misc_feature (127)..(127): n is a, c, g, or t
tcagacgctcgacacacgaccggtgctcgatttagtcacgcgagaaagggaaaggggctggccctgacgtgtttctgttcccgccctcctctgtcgagcgtctgagcgggctggcaaggcgcatagn

SEQ ID NO: 151986 - DNA, 126 bp, Homo sapiens
  misc_feature: GYAE6OF01AIH9Y.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaggggctggccctgacgtgtttctgttcccaccctcctctgtcgagcgtctgagcgggctggcaaggcgcatagn

SEQ ID NO: 151987 - DNA, 126 bp, Homo sapiens
  misc_feature: GYAE6OF01D2RWW.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaaggggctggccctgacgtgttctgttcccgccctcctctgtcgagcgtctgagcgggctggcaaggcgcatagn

SEQ ID NO: 151988 - DNA, 128 bp, Homo sapiens
  misc_feature: GYAE6OF01CYXF6.2.41.D08.1.454.CMB.1.raw
  modified_base (128)..(128): a, c, t, g, unknown or other
  misc_feature (128)..(128): n is a, c, g, or t
tcagacgctcgacacacgaccggtgctcgatttagtcacgcgagaaagggaaaggggctggccctggacgtgtttctgttcccaccctcctctgtcgagcgtctgagcgggctggcaaggcgcatagn

SEQ ID NO: 151989 - DNA, 129 bp, Homo sapiens
  misc_feature: GYAE6OF01D8S6D.2.41.D08.1.454.CMB.1.raw
  modified_base (127)..(129): a, c, t, g, unknown or other
  misc_feature (127)..(129): n is a, c, g, or t
tcagacgctcgacacacgaccggtgctcgatttagtcacgcgagaaagggaaaggggctggccctgacgtgtttctgttcccaccctcctctgtcgagcgtctgagcgggctggcaaggcgcatagnnn

SEQ ID NO: 151990 - DNA, 127 bp, Homo sapiens; identical to SEQ ID NO: 151979
  misc_feature: GYAE6OF01DI5TQ.2.41.D08.1.454.CMB.1.raw
  modified_base (127)..(127): a, c, t, g, unknown or other
  misc_feature (127)..(127): n is a, c, g, or t

SEQ ID NO: 151991 - DNA, 168 bp, Homo sapiens
  misc_feature: GYAE6OF01BG2CG.2.41.D08.1.454.CMB.1.raw
  modified_base (150)..(168): a, c, t, g, unknown or other
  misc_feature (150)..(168): n is a, c, g, or t
tcagacgctcgacacacgaccggtgctcgatttagtcacgcgagaaagggaaaggggctggcaaggcgcatagggctggcaaggcgcatagctgcctggtcaaggactacttcctgtcgagcgtctgagcgggctggcaaggcgcatagnnnnnnnnnnnnnnnnnnn

SEQ ID NO: 151992 - DNA, 127 bp, Homo sapiens; identical to SEQ ID NO: 151985
  misc_feature: GYAE6OF01CL9M3.2.41.D08.1.454.CMB.1.raw
  modified_base (127)..(127): a, c, t, g, unknown or other
  misc_feature (127)..(127): n is a, c, g, or t

SEQ ID NO: 151993 - DNA, 127 bp, Homo sapiens; identical to SEQ ID NO: 151979
  misc_feature: GYAE6OF01EQTF2.2.41.D08.1.454.CMB.1.raw
  modified_base (127)..(127): a, c, t, g, unknown or other
  misc_feature (127)..(127): n is a, c, g, or t

SEQ ID NO: 151994 - DNA, 128 bp, Homo sapiens
  misc_feature: GYAE6OF01AC8CT.2.41.D08.1.454.CMB.1.raw
  modified_base (128)..(128): a, c, t, g, unknown or other
  misc_feature (128)..(128): n is a, c, g, or t
tcagacgctcgacacacgaccggtgctcgatttagtcacgcgagaaagggaaagggggctggccctgacgtgtttctgttcccgccctcctctgtcgagcgtctgagcgggctggcaaggcgcatagn

SEQ ID NO: 151995 - DNA, 127 bp, Homo sapiens; identical to SEQ ID NO: 151979
  misc_feature: GYAE6OF01CTN47.2.41.D08.1.454.CMB.1.raw
  modified_base (127)..(127): a, c, t, g, unknown or other
  misc_feature (127)..(127): n is a, c, g, or t

SEQ ID NO: 151996 - DNA, 126 bp, Homo sapiens
  misc_feature: GYAE6OF01A5LWC.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaaggggctggccctgacgtgttctgttcccaccctcctctgtcgagcgtctgagcgggctggcaaggcgcatagn

SEQ ID NO: 151997 - DNA, 127 bp, Homo sapiens; identical to SEQ ID NO: 151979
  misc_feature: GYAE6OF01BJOP7.2.41.D08.1.454.CMB.1.raw
  modified_base (127)..(127): a, c, t, g, unknown or other
  misc_feature (127)..(127): n is a, c, g, or t

SEQ ID NO: 151998 - DNA, 129 bp, Homo sapiens; identical to SEQ ID NO: 151989
  misc_feature: GYAE6OF01EVSL3.2.41.D08.1.454.CMB.1.raw
  modified_base (127)..(129): a, c, t, g, unknown or other
  misc_feature (127)..(129): n is a, c, g, or t

SEQ ID NO: 151999 - DNA, 130 bp, Homo sapiens
  misc_feature: GYAE6OF01BTZV1.2.41.D08.1.454.CMB.1.raw
  modified_base (129)..(130): a, c, t, g, unknown or other
  misc_feature (129)..(130): n is a, c, g, or t
tcagacgctcgacacacgaccggtgctcgatttagtcacgcgagaaagggaaagggggctggccctggacgtgtttctgttcccaccctcctctgtcgagcgtctgagcgggctggcaaggcgcatagnn

SEQ ID NO: 152000 - DNA, 126 bp, Homo sapiens
  misc_feature: GYAE6OF01C4H4M.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaaggggctggccctgacgtgtttctgttcccgccctcctctgtcgacgtctgagcgggctggcaaggcgcatagn

SEQ ID NO: 152001 - DNA, 128 bp, Homo sapiens
  misc_feature: GYAE6OF01C32DR.2.41.D08.1.454.CMB.1.raw
  modified_base (128)..(128): a, c, t, g, unknown or other
  misc_feature (128)..(128): n is a, c, g, or t
tcagacgctcgacacacgaccggtgctcgatttagtcacgcgagaaagggaaagggggctggccctgacgtgtttctgttcccaccctcctctgtcgagagtctgagcgggctggcaaggcgcatagn

SEQ ID NO: 152002 - DNA, 141 bp, Homo sapiens
  misc_feature: GYAE6OF01ENC2D.2.41.D08.1.454.CMB.1.raw
  modified_base (121)..(121): a, c, t, g, unknown or other
  misc_feature (121)..(121): n is a, c, g, or t
  modified_base (127)..(141): a, c, t, g, unknown or other
  misc_feature (127)..(141): n is a, c, g, or t
tcagacgctcgacacacgaccggtgctcgatttagtcacgcgagaaagggaagggggctggccctgacgtgtttctgttcccaccctcctctgtcgagcgtctgagcgggctggcaaggcncatagnnnnnnnnnnnnnnn

SEQ ID NO: 152003 - DNA, 131 bp, Homo sapiens
  misc_feature: GYAE6OF01CTRV4.2.41.D08.1.454.CMB.1.raw
  modified_base (127)..(131): a, c, t, g, unknown or other
  misc_feature (127)..(131): n is a, c, g, or t
tcagacgctcgacacacgaccggtgctcgatttagtcacgcgagaaagggaaaggggctggccctgacgtgtttctgttcccgccctcctctgtcgagcgtctgagcgggctggcaaggcgcatagnnnnn

SEQ ID NO: 152004 - DNA, 705 bp, Homo sapiens
  misc_feature: GYAE6OF01AYUVJ.2.41.D08.1.454.CMB.1.raw
  modified_base (199)..(199): a, c, t, g, unknown or other
  misc_feature (199)..(199): n is a, c, g, or t
tcagacgctcgacacacgaccggtgctcgatttagtcacgcgagaaagggaaaggggagtctcagtcaggacacagcatggacatgagggtccccgctcagctcctggggctcctgctactctggctccgaggtgccagatgtgacactcctgatcgaccccagtcctccatccctccctgtctgcatcgtagtagganaccaggacgtccacctatcacgttcggcccgggacaaggtcagtacgtacagttacgcacgtacttaatttaaacgtggtatccagacgaacgaaaccgacgggaaaccaccccgtaactcctgactactattagtacacttctagttacgacgtaaaggtcgggtaccagtacgtaaggttcaggtcgcgaggtcgatcggtagggactagtactttacgacctacgtaccacgtactaccgagtccgtacgttctacgtacccgtaacgtacggttaagttacgtttactaaccttaacctttaaccgtaacgttacgtaaccgtaagtaacggttaacctttaaccggacccggttaacccccgtagggttaacccggttacccgggtaaccggtaaccgggtaaccggtaaacgggttaagaaaacccgtacgaaacggtacggtcgggtacgcgtacgtaacccacttaccgtcgttacgttccttaccgtcttacccccg

SEQ ID NO: 152005 - DNA, 132 bp, Homo sapiens
  misc_feature: GYAE6OF01BDYYJ.2.41.D08.1.454.CMB.1.raw
  modified_base (128)..(132): a, c, t, g, unknown or other
  misc_feature (128)..(132): n is a, c, g, or t
tcagacgctcgacacacgaccggtgctcgatttagtcacgcgagaaagggaaagggggctggccctgacgtgtttctgttcccgccctcctctgtcgagcgtctgagcgggctggcaaggcgcatagnnnnn

SEQ ID NO: 152006 - DNA, 125 bp, Homo sapiens
  misc_feature: GYAE6OF02I93JT.2.41.D08.1.454.CMB.1.raw
  modified_base (123)..(125): a, c, t, g, unknown or other
  misc_feature (123)..(125): n is a, c, g, or t
tcagacgctcgacacacgaccggtgctcgatttagtcacgcgagaaaggaaggggctggccctgacgtgtttctgttccacctcctctgtcgagcgtctgagcgggctggcaaggcgcatagnnn

SEQ ID NO: 152007 - DNA, 125 bp, Homo sapiens
  misc_feature: GYAE6OF02HE983.2.41.D08.1.454.CMB.1.raw
  modified_base (125)..(125): a, c, t, g, unknown or other
  misc_feature (125)..(125): n is a, c, g, or t
tcagacgctcgacacacgaccggtgctcgatttagtcacgcgagaaagggaagggctggccctgacgtgtttctgttcccgccctcctctgtcgagcgtctgagcgggctggcaaggcgcatagn

SEQ ID NO: 152008 - DNA, 126 bp, Homo sapiens
  misc_feature: GYAE6OF02IH4VF.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaaggggctggccctgacgtgtttctgttcccacctcctctgtcgagcgtctgagcgggctggcaaggcgcatagn

SEQ ID NO: 152009 - DNA, 125 bp, Homo sapiens
  misc_feature: GYAE6OF02G5O6A.2.41.D08.1.454.CMB.1.raw
  modified_base (125)..(125): a, c, t, g, unknown or other
  misc_feature (125)..(125): n is a, c, g, or t
tcagacgctcgacacacgaccggtgctcgatttagtcacgcgagaaagggaaaggggctggccctgacgtgttctgttcccacctcctctgtcgagcgtctgagcgggctggcaaggcgcatagn

SEQ ID NO: 152010 - DNA, 127 bp, Homo sapiens
  misc_feature: GYAE6OF02IR3BV.2.41.D08.1.454.CMB.1.raw
  modified_base (124)..(127): a, c, t, g, unknown or other
  misc_feature (124)..(127): n is a, c, g, or t
tcagacgctcgacacacgaccggtgctcgatttagtcacgcgagaaagggaagggctggccctgacgtgtttctgttcccgccctcctcttcgagcgtctgagcgggctggcaaggcgcatagnnnn

SEQ ID NO: 152011 - DNA, 125 bp, Homo sapiens
  misc_feature: GYAE6OF02FHDQI.2.41.D08.1.454.CMB.1.raw
  modified_base (125)..(125): a, c, t, g, unknown or other
  misc_feature (125)..(125): n is a, c, g, or t
tcagacgctcgacacacgaccggtgctcgatttagtcacgcgagaaagggaaggggctggccctgacgtgtttctgttcccgcctcctctgtcgagcgtctgagcgggctggcaaggcgcatagn

SEQ ID NO: 152012 - DNA, 126 bp, Homo sapiens
  misc_feature: GYAE6OF02HGGHE.2.41.D08.1.454.CMB.1.raw
  modified_base (125)..(126): a, c, t, g, unknown or other
  misc_feature (125)..(126): n is a, c, g, or t
tcagacgctcgacacacgaccggtgctcgatttagtcacgcgagaaagggaaggggctggccctgacgtgttctgttcccgccctcctctgtcgagcgtctgagcgggctggcaaggcgcatagnn

SEQ ID NO: 152013 - DNA, 126 bp, Homo sapiens; identical to SEQ ID NO: 151986
  misc_feature: GYAE6OF02H9DXO.2.41.D08.1.454.CMB.1.raw
  modified_base (126)..(126): a, c, t, g, unknown or other
  misc_feature (126)..(126): n is a, c, g, or t

SEQ ID NO: 152014 - DNA, 126 bp, Homo sapiens; identical to SEQ ID NO: 151986
  misc_feature: GYAE6OF02G02VT.2.41.D08.1.454.CMB.1.raw
  modified_base (126)..(126): a, c, t, g, unknown or other
  misc_feature (126)..(126): n is a, c, g, or t

SEQ ID NO: 152015 - DNA, 127 bp, Homo sapiens; identical to SEQ ID NO: 151979
  misc_feature: GYAE6OF02GVQ5U.2.41.D08.1.454.CMB.1.raw
  modified_base (127)..(127): a, c, t, g, unknown or other
  misc_feature (127)..(127): n is a, c, g, or t

SEQ ID NO: 152016 - DNA, 124 bp, Homo sapiens
  misc_feature: GYAE6OF02FGYUE.2.41.D08.1.454.CMB.1.raw
tcagacgctcgacacacgaccggtgctcgatttagtcacgcgagaaaggaaggggctggccctgacgtgtttctgttcccaccctcctctgtcgagcgtctgagcgggctggcaaggcgcatag

SEQ ID NO: 152017 - DNA, 126 bp, Homo sapiens; identical to SEQ ID NO: 151987
  misc_feature: GYAE6OF02I9ATK.2.41.D08.1.454.CMB.1.raw
  modified_base (126)..(126): a, c, t, g, unknown or other
  misc_feature (126)..(126): n is a, c, g, or t

SEQ ID NO: 152018 - DNA, 116 bp, Homo sapiens
  misc_feature: GYAE6OF02F1II2.2.41.D08.1.454.CMB.1.raw
  modified_base (116)..(116): a, c, t, g, unknown or other
  misc_feature (116)..(116): n is a, c, g, or t
tcagacgctcgacacacgaccggtgctcgatttagtcacgcgagaaagggaaagggcgtgtttctgttcccaccctcctctgtcgagcgtctgagcgggctggcaaggcgcatagn

SEQ ID NO: 152019 - DNA, 130 bp, Homo sapiens
  misc_feature: GYAE6OF02HHDQD.2.41.D08.1.454.CMB.1.raw
  modified_base (115)..(130): a, c, t, g, unknown or other
  misc_feature (115)..(130): n is a, c, g, or t
tcagacgctcgacacacgaccggtgctcgatttagtcacgcgagaaagggaagggcgtgtttctgttcccgccctcctctgtcgagcgtctgagcgggctggcaaggcgcatagnnnnnnnnnnnnnnnn

SEQ ID NO: 152020 - DNA, 145 bp, Homo sapiens
  misc_feature: GYAE6OF02FSA5L.2.41.D08.1.454.CMB.1.raw
  modified_base (128)..(145): a, c, t, g, unknown or other
  misc_feature (128)..(145): n is a, c, g, or t
tcagacgctcgacacacgaccggtgctcgatttagtcacgcgagaaagggaagggggctggccctggacgtgtttctgttcccaccctcctctgtcgagcgtctgagcgggctggcaaggcgcatagnnnnnnnnnnnnnnnnnn

SEQ ID NO: 152021 - DNA, 146 bp, Homo sapiens
  misc_feature: GYAE6OF02FSM2Q.2.41.D08.1.454.CMB.1.raw
  modified_base (129)..(146): a, c, t, g, unknown or other
  misc_feature (129)..(146): n is a, c, g, or t
tcagacgctcgacacacgaccggtgctcgatttagtcacgcgagaaagggaaagggggctggccctgacgtgtttctgttcccaccctcctctgtccgagcgtctgagcgggctggcaaggcgcatagnnnnnnnnnnnnnnnnnn

SEQ ID NO: 152022 - DNA, 126 bp, Homo sapiens
  misc_feature: GYAE6OF02FQNZL.2.41.D08.1.454.CMB.1.raw
  modified_base (126)..(126): a, c, t, g, unknown or other
  misc_feature (126)..(126): n is a, c, g, or t
tcagacgctcgacacacgaccggtgctcgatttagtcacgcgagaaagggaaaggggctggccctgacgtgtttctgttcccgcctcctctgtcgagcgtctgagcgggctggcaaggcgcatagn

SEQ ID NO: 152023 - DNA, 161 bp, Homo sapiens
  misc_feature: GYAE6OF02H9K1J.2.41.D08.1.454.CMB.1.raw
  modified_base (127)..(161): a, c, t, g, unknown or other
  misc_feature (127)..(161): n is a, c, g, or t
tcagacgctcgacacacgaccggtgctcgatttagtcacgcgagaaagggaagggggtctggccctgacgtgttctgttcccaccctcctctgtcgagcgtctgagcgggctggcaaggcgcatagnnnnnnnnnnnnnnnnnnnnnnnnnnnnnnnnnnn

SEQ ID NO: 152024 - DNA, 126 bp, Homo sapiens; identical to SEQ ID NO: 151996
  misc_feature: GYAE6OF02JELZ2.2.41.D08.1.454.CMB.1.raw
  modified_base (126)..(126): a, c, t, g, unknown or other
  misc_feature (126)..(126): n is a, c, g, or t

SEQ ID NO: 152025 - DNA, 133 bp, Homo sapiens
  misc_feature: GYAE6OF02HV128.2.41.D08.1.454.CMB.1.raw
  modified_base (127)..(133): a, c, t, g, unknown or other
  misc_feature (127)..(133): n is a, c, g, or t
tcagacgctcgacacacgaccggtgctcgatttagtcacgcgagaaagggaaaggggctggccctgacgtgtttctgttcccaccctcctctgtcgagcgtctgagcgggctggcaaggcgcatagnnnnnnn

SEQ ID NO: 152026 - DNA, 160 bp, Homo sapiens
  misc_feature: GYAE6OF02GWI39.2.41.D08.1.454.CMB.1.raw
  modified_base (77)..(77): a, c, t, g, unknown or other
  misc_feature (77)..(77): n is a, c, g, or t
  modified_base (121)..(121): a, c, t, g, unknown or other
  misc_feature (121)..(121): n is a, c, g, or t
  modified_base (125)..(125): a, c, t, g, unknown or other
  misc_feature (125)..(125): n is a, c, g, or t
  modified_base (127)..(160): a, c, t, g, unknown or other
  misc_feature (127)..(160): n is a, c, g, or t
tcagacgctcgacacacgaccggtgctcgatttagtcacgcgagaaagggaaagggggctggccctgacgtgtttcngttcccaccctctctgtcgagcgtctgagcgggctggcaaggcnctangnnnnnnnnnnnnnnnnnnnnnnnnnnnnnnnnnn

SEQ ID NO: 152027 - DNA, 153 bp, Homo sapiens
  misc_feature: GYAE6OF01DIKMG.28.24.C02.1.454.CMB.1.raw
tcagagtacgctatcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatag

SEQ ID NO: 152028 - DNA, 173 bp, Homo sapiens
  misc_feature: GYAE6OF01EEFMI.28.24.C02.1.454.CMB.1.raw
  modified_base (157)..(173): a, c, t, g, unknown or other
  misc_feature (157)..(173): n is a, c, g, or t
tcagagtacgctatcacgaccggtgctcgatttagtacagatcgttagggcaagggaccaaggtggagatcaaacgaactgtggctagaaccatctgtcttcatccttcccgccatctgaatagcgtactctgagcgggctgggcaaggcgcatagnnnnnnnnnnnnnnnnn

SEQ ID NO: 152029 - DNA, 155 bp, Homo sapiens
  misc_feature: GYAE6OF02HYC4C.28.24.C02.1.454.CMB.1.raw
  modified_base (154)..(155): a, c, t, g, unknown or other
  misc_feature (154)..(155): n is a, c, g, or t
tcagagtacgctatcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnn

SEQ ID NO: 152030 - DNA, 154 bp, Homo sapiens
  misc_feature: GYAE6OF02F35FF.28.24.C02.1.454.CMB.1.raw
  modified_base (154)..(154): a, c, t, g, unknown or other
  misc_feature (154)..(154): n is a, c, g, or t
tcagagtacgctatcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagn

SEQ ID NO: 152031 - DNA, 171 bp, Homo sapiens
  misc_feature: GYAE6OF02GAAMT.28.24.C02.1.454.CMB.1.raw
  modified_base (154)..(171): a, c, t, g, unknown or other
  misc_feature (154)..(171): n is a, c, g, or t
tcagagtacgctatcacgaccggtgctcgatttagtacagatcgttagggaaagggaccgaaggtggagatcaaacgaactgtggctgcaccatctgtcttcatcttcccgcatctgaatagcgtactctgagcgggctggcaaggcgcatagnnnnnnnnnnnnnnnnnn

SEQ ID NO: 152032 - DNA, 160 bp, Homo sapiens
  misc_feature: GYAE6OF02GQ2SG.28.24.C02.1.454.CMB.1.raw
  modified_base (154)..(160): a, c, t, g, unknown or other
  misc_feature (154)..(160): n is a, c, g, or t
tcagagtacgctatcacgaccggtgctcgatttagtacagatcgttagggcaaagggaccaaggtggagatcaaaacgaactgtggctgcaccatctgtcttcatcttcccgcatctgaatagcgtactctgagcgggctggcaaggcgcatgnnnnnnn

SEQ ID NO: 152033 - DNA, 502 bp, Homo sapiens
  misc_feature: GYAE6OF01C2WHM.45.70.G04.1.454.CMB.1.raw
  modified_base (303)..(303): a, c, t, g, unknown or other
  misc_feature (303)..(303): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctcctggtaccaacaacacccaggcaaacgccccaaactcatgatttangatgtcagtaatcggcctcgagggtttctgatcgcttctctggctcaagtctggcaacacggcctccctgaccatctctgggctccgaggctgaggacgaggctgaatttattactgcagtctcatatgacacgcagcatgactntagtntcggcggaggaccagctgaccgtctaggtcagcccaaggctcgtccccg

SEQ ID NO: 152034 - DNA, 668 bp, Homo sapiens
  misc_feature: GYAE6OF01C8FH9.45.70.G04.1.454.CMB.1.raw
  modified_base (307)..(307): a, c, t, g, unknown or other
  misc_feature (307)..(307): n is a, c, g, or t
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttatataactatgtctcctggtaccaacaaccaccaggaccaaacgcccccaaaactcatagatttangtaatgtacagtaatccggaccttcgtaggggtttctaggactccgtctttctcgtcggacctccgtaaagttcgtacggacaacgaccgggcccttcccgtagtaaccctacttccttaccgtggggcctccgaaggtccgtaggaacgggaacgagggtccttaggtaactttaagttaccgtgaccgagtccttacattagtcgaccacgactacgaccagttacgtacttacgtaagttacgtccggggacggtaacgggtaacccaaagggtcccgttacggacccccggtttaaccgttacgggacctaaacgggacccccgaaaggggtcccctaccccggttaccccccccgg

SEQ ID NO: 152035 - DNA, 638 bp, Homo sapiens
  misc_feature: GYAE6OF01ENMZA.45.70.G04.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccngcagtgacgttggttattataactatgtctctgtaccaacaacaccaggcaaacgccccaaatcatgatttangatgtcagtaatccggccttgaggggtttctgatcgtcttctctggctccaagtctggaccaacgaccggtccctcccgtgaccctacttccgtcgtcgggcccttcccgaggtctaggagggaccggaggtcctaggtaactttacgttactgcgagtcttacattagtcgccaacgcgtagcctaagttcgaccttcgttaaggttacggttaccggggaccggggtaacgggtaaacccctaagggtccggttaccggaaaccccgttccggttaaaccgggtacccaacccgggaaccccgtaacgggtccccgttcccgggtaccccccccgg

SEQ ID NO: 152036 - DNA, 531 bp, Homo sapiens
  misc_feature: GYAE6OF01BQXUO.45.70.G04.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (423)..(423): a, c, t, g, unknown or other
  misc_feature (423)..(423): n is a, c, g, or t
tcagacgcgatcgacacgaccggtgctcgatttagtgtagtgtgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccagcagtgatgttgggattataaccttgtctcctggtaccaacagcacccaggcaaacgcccccaaatcatgatttangagggcagtaagcggccctcgtagggtttctaatcgcttctctggctcaagtctggcaacacgcctccngacatctctggctccaggctgaggacgagctgatttatactgctgctcatntgcgacgggacagtcagttgggtgttcgggcggacgggacctagggttcgacccggttctaggtccacggaccccgtaaggccttccggcccccgttggtccctaccg

SEQ ID NO: 152037 - DNA, 559 bp, Homo sapiens
  misc_feature: GYAE6OF01B3I8F.45.70.G04.1.454.CMB.1.raw
  modified_base (269)..(269): a, c, t, g, unknown or other
  misc_feature (269)..(269): n is a, c, g, or t
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
tcagacgcgatcgacacgaccggtgctcgatttagtgtagtgtgaagggaaagggggggtctcaggaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatgtggattttagtttgtctctgtaccaacacacccgnaacgccccaaatatcatttataggacactaagcggcccgtcggggttcaagtcgnttctctggctccagtctgacacacgcctccctgacatctctggctccgaggctcgaggacgagctgtatttatttctgttacgcttcatntgcgaggaccagcctagttgggtcgttcgggacgggagggtaccgtaggttacgacccgtcgtaggtcgacgtacccgaaggccgtacgcccccgttggtcccacgttcccgtacgttcccccaccccgttcctccttcgtaccg

SEQ ID NO: 152038 - DNA, 540 bp, Homo sapiens
  misc_feature: GYAE6OF01CR2KV.45.70.G04.1.454.CMB.1.raw
  modified_base (300)..(300): a, c, t, g, unknown or other
  misc_feature (300)..(300): n is a, c, g, or t
  modified_base (330)..(330): a, c, t, g, unknown or other
  misc_feature (330)..(330): n is a, c, g, or t
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttatataactatgtctcctggtaccaacaacaccaggcaaagcccccaaatcatgatttangatgtcagtaatcggccctcaggggtttcngatcgcttctctggctccaagtctggcaacacggcctccctgaccatcgtctgggctccgaggctgaggacgagctgattattactgcagctacatatgcacgcagcagtcgacttacgtagttagttccgggacggagggtacccaagccgtacgacccggttaccgtacgggtacaacggccccaacgggtcctcccggtccccccgg

SEQ ID NO: 152039 - DNA, 728 bp, Homo sapiens
  misc_feature: GYAE6OF01CTAKE.45.70.G04.1.454.CMB.1.raw
  modified_base (341)..(341): a, c, t, g, unknown or other
  misc_feature (341)..(341): n is a, c, g, or t
tcagacgcgatcgacacgaccggtgctcgatttagtgtagtgtgaagggaaagggggggtctcgaggaggcagcgctctcgggacgtctccaccatggcctgggctctgctattcctcaccctcctcactcgaggcacagggtcctgggcccagtctcgccctgactcagcctgcctccgtgtctgggtctcctggacaggcgatccaccatcctcctgcactggaaccagcagtgacgttggttatatactagtgtctcctggtaccaacaacaccaggtacaaacgccccaaactcatgtatttaatgatgtcaagtaactcggcctcgtagggtttcngatcgtcttctctggctacaagtcgtgacaacgtacggcctccctgaccctatcgttcgtcggggtcctccgaagggtcttacgggaacggtaccggaacggtaccttacggtaactttaacgtttaacccgtggtccgttcggtaccttaccgaatttacgtacggtaccgttaaggggtttaacgggtttagtttaaccggttttttcggggttaacgggttttcggggaaccgggttaaacgggggtaccctaaaacgggtcccggttaccggtaaccccgggtttccgttaaacggggttcccgaaccgggtacccccggtaaaaggggtccccttacccgggtccccccgtttaacgggtcccttaacccggtttaccccgg

SEQ ID NO: 152040 - DNA, 709 bp, Homo sapiens
  misc_feature: GYAE6OF01EWWAT.45.70.G04.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
tcagacgcgatcgacacgaccggtgctcgattttagtgtagtgtgaaggggaaaggggggggtctcaggaggcagcgctcgtcgggacgtctccaccatggcctgggctctgctattcctcaccctctcactcagggcacagggtcctgggcccagtctgccctgactcagcctgcctccgtgtctgggtctctggacaggcgatcaccatcctcctgcactggaaaccngcagtgacgtttgttattanaactatgtctctggtaccaacaacaccaggcaaacgccccaaactcatgatttatgatgtctagtaactccggccctgaggggtttctagtactcgtcttctcgtggcctaccgaaggttcgtacggtacctaaccgtaccggtccccttacccgtagtaccctattaccgttccggtacgggtacccttaccgaacgggtcgtagggaacggaacggaggtcgttacgtaattttaacgtttaaccgtgtaccgtagtcccttactaattactcgtaccgtaaccgcgtaacgaccttaagtccggtaaccgtttaccgttaaggttaccggtttaccggggaacgggtaaccggggtaaaccctaagggttcccggtaacgggtacccccggtttagtaccgggttaaccgacccggtaaccccgtaagggttccccttacccgggttacccccccg

SEQ ID NO: 152041 - DNA, 626 bp, Homo sapiens
  misc_feature: GYAE6OF01AOHD0.45.70.G04.1.454.CMB.1.raw
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacaggcgatcaccatcctcctgcacgtcggaaccngcagtgtacgtttggttattataactatcgtctcctggtaaccaacaaccaccaggaccaaacgcccccaaactcatgtactttangatgtcaagtaactcggtccctgtacgggtttctgtatcgcttctcgtgcctacgagtctcggaccacgacccggtccctcccgtacgtaccctagttccctcggtcggtcctaccgaaggtccgtacgggacggtacggacgtcgttacggtatttacgtacgtgacgngtcctagtatgcgacgaccgntacgctatacgtcttacgtacgtacggttacggggacggtaaccggaccgtagtaccggtccggtaccgtaccgttacgtacggaacccgtacggacggtccccggtcccgtccccgg

SEQ ID NO: 152042 - DNA, 664 bp, Homo sapiens
  misc_feature: GYAE6OF01D57UJ.45.70.G04.1.454.CMB.1.raw
  modified_base (200)..(200): a, c, t, g, unknown or other
  misc_feature (200)..(200): n is a, c, g, or t
  modified_base (255)..(255): a, c, t, g, unknown or other
  misc_feature (255)..(255): n is a, c, g, or t
tcagacgcgatcgacacgaccggtgctcgatttagtgtagtgtgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacnggcgatcaccatctcctgcactggaacagcagtgtacgttggttattactaactntgtctccgtacggtaaccaaacaaccacccgaggacaaaccgaccccaaactcattagtatttagtgtagtcgtactagtaactccggaccgttgtaggggtttcagtactcgtcttcgtcgtcggtcctacgaacgtcgacgtacaaccgaccggtccctccgtacgaccctacgtcgttcggtcggtaccctcggacggtcgtagggacggacggacggtcttacgtaagttttactacgtcgcgtacgtactacgtaatacgcgacaccgactagctattacgtaccgttacgttaacggttacggtcggggaaccggtaacggtaacgtacggtccgtaccggtaacccgttccggtaacggaccgtaacccgacccggtaccggtccgtccccgggtacccccg

SEQ ID NO: 152043 - DNA, 623 bp, Homo sapiens
  misc_feature: GYAE6OF01BR7AK.45.70.G04.1.454.CMB.1.raw
  modified_base (360)..(360): a, c, t, g, unknown or other
  misc_feature (360)..(360): n is a, c, g, or t
  modified_base (453)..(453): a, c, t, g, unknown or other
  misc_feature (453)..(453): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacaggcgatccacatcctcctgcacgtggaaccagcagtcgtacgttggttattaagtaactatgtctctacggtaaccaacgaacaccaggaaccaaacgaccccaaactctatacgtatttatgtatcgtactaacgtaagtccggaccttcggtagggtttcngtactcgtcttctcgtggctacgaacgtcgtagaccaacgaccgtcctacctcgaccattccgtcgtcgggcctcgagtcgtaggacggacgnggtactagtaacttagtacgttgacgagtactacaagttacgtcggactacggacacgtctagtcgtactacgttaggtacggttacgggacggtaacgggactaaggccgtacggacccgttacggaacggttaccacggaacccgaacggtcccgtcccgtaccccgg

SEQ ID NO: 152044 - DNA, 644 bp, Homo sapiens
  misc_feature: GYAE6OF01AIODB.45.70.G04.1.454.CMB.1.raw
tcagacgcgatcgacacgaccggtgctcgatttagtgtagtgtgaagggaaaggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacaggcgatcaccatcctcctgcactggaaccagcacgtgtacgtttggttattataactgtgtctccgtacggtaaccaaccaaccacccgaacggaccaaaccgaccccccaactacattgtatttatgactgtactagtaactccggtcctcgtacgggtttctcgactcgtcttcttactcggtacctaccaacgtcgtacggacaaccgaccggtccctacccgtcgacctacttccgtccgtggtcctccgacggcgtgggacggacggtagtcgttacgtaattacgttacgtctacgagtcctactactactacgcgtaccgacgacgtactacgtcgtacgtacgttacggtcggtacggacggaacgggtaccgacggtccgtacggtacccgtacgtacggtaccgaccggtacccgcgtacccgtcccgtacccccgg

SEQ ID NO: 152045 - DNA, 663 bp, Homo sapiens
  misc_feature: GYAE6OF01CCVXF.45.70.G04.1.454.CMB.1.raw
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagacgcgatcgacacgaccggtgctcgatttagtgtagtgtgaaggggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacaggcgatcaccatcctcctgcacgtggaaccagcaggtgacgttggttattataactatgtctctagtaaccaacaaccacccgaggacaaacgacccccaaactcactgtatttangtatgtcaagtactccggcctgtagggttcngatcgtcttctcgtcgtcctacgtagtcgtacgaccaaccgacccgggtccctcccgtacgtacccacttccgttcgtaccgggtcctaccggacgggtcgtacgggacgggacgtacggtactaggttactttacgtactcggactacggtacctactaacgttacgtcggaccgaccggacgtacaccgtattacggtacttcggttaagtaccgggttccgggaacggggtacggaaaccgtaggacccggttaccggtaccgtccggtacgggaccacccggacccgacggtccgtccccggtccccccgg

SEQ ID NO: 152046 - DNA, 753 bp, Homo sapiens
  misc_feature: GYAE6OF01D3TL7.45.70.G04.1.454.CMB.1.raw
  modified_base (233)..(233): a, c, t, g, unknown or other
  misc_feature (233)..(233): n is a, c, g, or t
tcagacgcgatcgacacgaccggtgctcgatttagtgtagtgtgaagggaaaggggggggtctcaggaggcagcgactctcgggacgtctccaccatggcctgggcttctgcttacttcctcaccctctcactcagggcacagggtcctgggcccaggtctgccctgactcagcctgcctcgtgtctgggtctcgtggacagtcgatcaccatggcctgcacgtggaaaccanagtgattggtttagggtatttttagttttgtctccgtaggttaaccaacaaccgaccccggacgaaccgacccccaaattaactctaatttagtacgggaccaacgtaacggccggtccggtttcgggggtttacaacggttccgtctttctcgtggcctaccaaggttcacggtaccaaccgaccggtcccttcccgtacgaccctattccgtcgtcggggtcctaccggaggtacctgggaacgggacggtacgggcttagtaactttacgttacgttcgactacgtccttactattacgtcgacgtacgacgagacctagtacgtactttacggtaaggtttaccggtacggggtaccggggaacggtaaccgaaggtccgtcggtaacccggttaccgtacgggtacccgtaaccgggtacccggaaccggttcccgttacccccgtcccccggttacggttccccttaacccgtttcccgtttacccccggttcccccgtcccgttttacccccg

SEQ ID NO: 152047 - DNA, 684 bp, Homo sapiens
  misc_feature: GYAE6OF01CYKJL.45.70.G04.1.454.CMB.1.raw
  modified_base (230)..(230): a, c, t, g, unknown or other
  misc_feature (230)..(230): n is a, c, g, or t
  modified_base (498)..(498): a, c, t, g, unknown or other
  misc_feature (498)..(498): n is a, c, g, or t
  modified_base (577)..(577): a, c, t, g, unknown or other
  misc_feature (577)..(577): n is a, c, g, or t
  modified_base (625)..(625): a, c, t, g, unknown or other
  misc_feature (625)..(625): n is a, c, g, or t
  modified_base (657)..(657): a, c, t, g, unknown or other
  misc_feature (657)..(657): n is a, c, g, or t
tcagacgcgatcgacacgaccggtgctcgatttagtgtagtgtgaagggaaaggggggggtctcaggaggcagcgctcgtcgggacgtctccaccatggcctgggctctgctattcctcaccctcctcactcagggcacagggtcctgggcccagtctgccctgactcagcctgcctcgtgtctgggtctccgtggacagggcatcaccatcctctgcctagtacgaccnacgtagtgtacgtttagttaattaactacttgtcgttctccgtacgtaaaccaacaacccaccgacggaaccaaacccgacccctaaatcgattagttaagtttacgagtacgttgtaacgtaagttaccggtccggtacccttacgggtttacggttactacgtactttccggtctttccgtcggtccgtacccttaacgtacgtttccgacggtacccgaaccgtccccgtcctaccgactacctacgtcctcggcgtaccgtcgnggtacgagggacgtacgtagtcttaggttacttcgtacgctatcgtactacgtaattcgaccaccgtacgattacccgntaacgttcgacttacgttaagggtccggtccggggaagaccggtaacncgtccggttaccgtaccgtcgtaggtaacccncgtaaccggtctcccgacccgttcccg

SEQ ID NO: 152048 - DNA, 698 bp, Homo sapiens
  misc_feature: GYAE6OF01D5Q85.45.70.G04.1.454.CMB.1.raw
tcagacgcgatcgacacgaccggtgctcgatttagtgtagtgtgaaggggaaaggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacagtcgatcaccatggcctgcactaggaaccaagagtgattggttgggtattttagttgcctctgtaccaacaacgaccccggacgaaccgaccccaaactaatctatttagacggacactaaggccggtcccgtcggggttcaacgtcgtcttctcgtcgctcctaagtctaggaccacgaccggtccctccgtgaactactacttcgtcgggcctccgacggtccgtaccgaagggtaccggagggtaccttaggtaacgttttacttttcgtttagtttcggaccttattaactacgttacggaaccggtacgggtaccctaacggtccgttaaccgggtttggggtcggtttaaccggggcgggtaacgggtaccgtaagggttccgtaaccggttcgtacgggcacggtacctaccgggcctcccggtccccgtcggtacctcccgttccgttcccgaaccccttcccccgtactacccgtcgtacgtcgtacccg

SEQ ID NO: 152049 - DNA, 656 bp, Homo sapiens
  misc_feature: GYAE6OF01C3Y9Q.45.70.G04.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (469)..(469): a, c, t, g, unknown or other
  misc_feature (469)..(469): n is a, c, g, or t
  modified_base (500)..(500): a, c, t, g, unknown or other
  misc_feature (500)..(500): n is a, c, g, or t
tcagacgcgatcgacacgaccggtgctcgatttagtgtagtgtgaagggaaagggggggtcacaagaggcagcgctctcgggacgtctccaccatggcctgggctctgctgctcctcactctcctcactcgaggacacgcgggtcctgggcccagtctcgccctgactcagcctgcatccgtgtcgtggtctccgtgacagtcgactcaccatctccngcacgtcgaaccngtcagtgagtggttaggattactaccttgtctccgtacgtaaccaacacgaccaccgacgaacaaccgtaccccaatacaagtgtaagtttagaggacggtagaacggtaacgtccggtacgttacggtacggtttactactccgtcttcgtacgtcggaccttacgaagtcggtacgaactacgcgtcctacgactactactcgtcgcggtcctcgaaggtcagggtacggaacgtntacgtagtactttatacgtctacgtacttanacttagtaacgtcgtaacgggtagtttaacggttagttttcggttggtcggggtaacgggacgggtaaaccgacgtaacggtcgttacccgaccggttaacggacgtacgtaacccgaacggttaccgacgttaccccgcccgttcggttaacccc

SEQ ID NO: 152050 - DNA, 736 bp, Homo sapiens
  misc_feature: GYAE6OF01AF9A6.45.70.G04.1.454.CMB.1.raw
  modified_base (371)..(371): a, c, t, g, unknown or other
  misc_feature (371)..(371): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccctgtctgggtcctccgtggacagtcgatccaccactcccctgcctactggactccgagcggtgacgttacttgttttaagatgtcctcgtggtactcgagaccaaccaccgaggaccaaaccgcccccaaacttcacgttactattttagtcgatgtacaattaacgtccggtcccgtacggtacgggtttcnctactcgtcttctcgtcgctaccgagtctagactacgtaccgtcctaccgtcgacctgtccgtcgtacggtccctacgaggtacacgggtaacggaccggagtaccgtattacgtttactacgcgtacgacgtacaacggttaattaagttacgtttaacgtttaccggttacccttacgggttaccgtttacggggttcccgggtacgggtaccgggtaacccgtacgggtttacccggtaccggtttacccggtacgggtaccccttaccgggaaccctaccggggttacccccgtaccccggtaccccggttttaccgaacccggttttaccccgttccccgttcccccgttaaccccccgg

SEQ ID NO: 152051 - DNA, 886 bp, Homo sapiens
  misc_feature: GYAE6OF01C2Q4Y.45.70.G04.1.454.CMB.1.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (724)..(724): a, c, t, g, unknown or other
  misc_feature (724)..(724): n is a, c, g, or t
tcagacgcgatcgacacgaccggtgctcgatttagtgtagtgtgaagggaaaggggggggtctcaggaggcagcgctcgtcgggacgtctccaccatcggcctggctctgctattcctcaccctcctcactcgagggcacgtagggtcctgggcccctagtctcgcccttagactcgacgcctcgcccttccggtgtcgttggggtcctccgtagggacngggctactaccaaccncttcccggtcnccgtacgaacggtaccgaaaccgagcggttacgtacgggtttaacgttttagttaaacttaactaacgtttgtccgttaccctccggtaacccgtaaaccaaaaccaaccgaacccggaacggtaacccaaacccgtaccccaatactaggttacttagtatcgttacacgttaacgtaacgtaccggtccggttaaccgttaccgggttttagggttacgttcgtaccgtttacggtttccgtttaaccgttcgggttaccccgttaccggggtaaccctttacggttaacccggacgtaaacccccggttacccgggttaacccgttcccccctaaaccgtaaaccggtcccttaccggttacccggttcgggtccttaaccggggtccgttaaacggtaccgggaacgggtacgggttaacgggtaccgtaggtttaacgtttacgttacgtttacgaacgttcgaaccctttntacgtaagtccgactaacgccggaacgttaacctggacctttacggagtttaccggtaacgggtaccggtacgggaacgtaccgggaaacggtacgttacccgtacggtaccgttccggaacgttccgaaccggtactacccggcggtcccccgttacccgg

SEQ ID NO: 152052 - DNA, 806 bp, Homo sapiens
  misc_feature: GYAE6OF01AVHW2.45.70.G04.1.454.CMB.1.raw
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctccgtgcactggatccgaggcggtgtaacgtttacgtttaggtttttaaagtattcgttacttccgtaggtactcacgaccaaaccgtacccgaaggaccaaaaccggtcccccaaaacttcctaactttacctaattttagtagacttacgtaacgtaaaactaccgtaccggtaccccgttaccggttaacggggtttttcccacgttacgttaccgttccttttaccgtcgtaccgggtctaaccgtaaacgtttccggtaacggaacccgtaaacggttacccgccccttaccccgtagtaaccctatttccgtaccggttcgggccttaccggacgggtacgtacggaaacgggtccggtaagtaccgttagttaacgtttaaccttacgtcgaccgtaactactaagttaacttaacgtttaacgtttacgttaccgtttacgtaccgttacggggtttacggtacgggtacgggaacgggtaacccgtaggttacccggacccggtttaccgttaggtaccacccggaccgtaccgggttcccgtcccggtaccccccgttaggtaccccttcgttccccgttaccccg

SEQ ID NO: 152053 - DNA, 706 bp, Homo sapiens
  misc_feature: GYAE6OF01CQM7R.45.70.G04.1.454.CMB.1.raw
  modified_base (138)..(138): a, c, t, g, unknown or other
  misc_feature (138)..(138): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcaggcacngggtcctgggcccagtctgccctgactcagcctgcctcgtgtctgggtctcgtggacnggcgatccacntctcctgcacgtcgaaccngcagtgtagtttgttatatactntntctctagtaccaacacaccagacaacgccccaaatcatctatttataggaggtactagtacggcccggtccgtcgtaacggggttttactaagttccgtcgtttacctcgtcggtcctaccgtagtccgttacggaccaaaccgtaccgcccgttacccgtcgtaaccaacgttcgtccggtacggtcctaaccggtacggtccgttacgggaacgggtaccggtaggtaccgttagtaactttacgtttaccgtgtacccgttcgtccgtacgtattacgtcggtacggtaacgtttaggttacggtttacgtttggggttacggttccgggtaacgggacggtaaccgtaacggtcgtacccggtcccgtacggtacccggtacacggtacccgtaacggtcccgtccccgtacccgtcggtaccctccgttcccgttcccgttaccccccgg

SEQ ID NO: 152054 - DNA, 850 bp, Homo sapiens
  misc_feature: GYAE6OF01CQRV3.45.70.G04.1.454.CMB.1.raw
tcagacgcgatcgacacgaccggtgctcgatttagtgtagtgtgaagggaaagggggggtctcaggaggcagcgctctcgggacgtctccaccatggcctggctctgctattcctcaccctcctcactcaggcacagggtcctgggcccagtctgccctgctcagcctgcctccgtgtcgtgggtcctccgtaggacgaggccgatccacccatcctcctgcctaacgtacggaaccagcgaaggtggtacgttttaggttaattaacgtaacttagtcgttaccttaccgtaacgtaaaccaaaccgaacccgaaccgaaccggaacctaaaccccgtaacccccctaaaactcctaagttacgttaagtttaacggtacgggaacggtaacgtaacggtaccggtcccggtaccggttacgggttaacggtttaactaacgttccgttaccgttcgtcgtcgtaccgtaaccgtacggttaccgtacgaaccgtaacccgtcccggtacccttaccgtacgtaaaccgttaccgttccgtaccggtacggtaccgtacggtcggtacggtaacgggaccgggtacggtacgtacgtttaacgttacgttacgttccgtacgtcgtcgtactacgtaagtcgttacgtaacggttaggtttaacggtttacggtttacgggttcgggttacgggtaacccgggtaacgggtaccgtaaccggtcgttaccggtacccggttaaccggttacggtaccggaccggtaacccgggtacccgtaccggtccccggttaccccgttacccggttaccgttacccgttacccgttccccgttaccccgtacccc

SEQ ID NO: 152055 - DNA, 808 bp, Homo sapiens
  misc_feature: GYAE6OF01CMLSS.45.70.G04.1.454.CMB.1.raw
  modified_base (146)..(146): a, c, t, g, unknown or other
  misc_feature (146)..(146): n is a, c, g, or t
  modified_base (154)..(154): a, c, t, g, unknown or other
  misc_feature (154)..(154): n is a, c, g, or t
  modified_base (699)..(699): a, c, t, g, unknown or other
  misc_feature (699)..(699): n is a, c, g, or t
tcagacgcgatcgacacgaccggtgctcgatttagtgtagtgtgaaggggaaaggggggggtctcaggaggcagcgctcgtcgggacgtctccaccatggcctgggctctgctattcctccacccttcctcactcgagggcaacgngggtccgngggcccagtctcgccctagacctccgacgtcctcgccgttccgttcgtcgttcgggtcctccgtacgggacgaggtccgatccaccacttcctcctgaccaccgtacgggaaaccaggtccgtaggtacggttacgtttaggtttaactaacgtatacgtcgttcctaccgtaaccgtaaccaacgaaaccctaccggaacgaaccgaaaaccgacccccaaatacctaagttaacttaagtttacgtacgtagtacgttactaacggtaccgttccggtaccgttacggttacgggttctacgtacgtccttcttcgtcgtacggtacctacggtaacgtcggtacgccgtaaacgcccggttacctaccgtcaccgttgtccgtacggtaccggtcctacggtacgggcgttacgggaaggtaccgcgtacgtacgttacgttaacgtcggtctcgacgttcctaagtaactcgtacgaccgtaccgtacacgtcgtaagttacccgagttttacggtaaaccgggttcgggtaaacccgggngggttaaacccggtaccgaaaggtttacccgtcgggtaaccccgttaacggtacccgacgggaacccggtttcccgggaaccccttccgggttaccccggttaccccgg

SEQ ID NO: 152056 - DNA, 566 bp, Homo sapiens
  misc_feature: GYAE6OF02JEU37.45.70.G04.1.454.CMB.1.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctctggtaccaacaacacccaggcaaacgcccccaaatcatgatttangatgtcagtaatcggccctgagggtttcngactcgcttctctggctcagtctgcaacacgcctcctgacctatctcgtggctcgaggctaggagacgaggctgtattatactgacagctcattagtcgacacgcacgtcaagtcgtaaccttgtaagttacggttccgggacgggaacgggtaaccgaaggtccgttaaccggtacccggttaccgtacgggtaccgaccggacccggaacggtccgtcccggtacccccgg

SEQ ID NO: 152057 - DNA, 196 bp, Homo sapiens
  misc_feature: GYAE6OF02HD48R.45.70.G04.1.454.CMB.1.raw
  modified_base (196)..(196): a, c, t, g, unknown or other
  misc_feature (196)..(196): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctctggan

SEQ ID NO: 152058 - DNA, 516 bp, Homo sapiens
  misc_feature: GYAE6OF02HHHV5.45.70.G04.1.454.CMB.1.raw
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctcctggtaccaacaacacccaggcaaagcccccaaatcatgatttangatgtcagtaatccggccctcgaggggtttcngatcgcttctctggctcagtcngcacncggcctcctgaccatctctgggcctccgaggctggaggacgaggctgattattactgcagctacattancgacacgcagcatgacttgtagtacgtcggacggacgggaccagcgtagacccgtctaggtcacgcccgaaggtcctccgccccg

SEQ ID NO: 152059 - DNA, 647 bp, Homo sapiens
  misc_feature: GYAE6OF02GI9NV.45.70.G04.1.454.CMB.1.raw
tcagacgcgatcgacacgaccggtgctcgatttagtgtagtgtgaagggaaagggggggggtcgtcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattactacttgtctctgtacaacagcaccagcaaacgccccaactcatgtattagtggagggcagtaacgccggtccctcgtaggggtttctaacgtcgtcttctcgtcgctccgaagtcgtcggacaaaccgcccggtccctaccctcgaactaaacgttcgtaccgtcgggtcctaccggacggtcgtaggaacgggaccgagggtccctaggtactttacgttacgtcgctcgtcctactattacgtcgagtacgggtagtttacggtttactttggggtcgttacgggcgggtaacgggacccgaaggtccgtacggtacccggttaccgttaacgggtaccgtaccgacccggtaagggccccgttaccccggacccccgggtttcgtacccctacccg

SEQ ID NO: 152060 - DNA, 672 bp, Homo sapiens
  misc_feature: GYAE6OF02HK8WE.45.70.G04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccngcagtgacgttgttatataactatntctcctggtaccaacaacacccaggacaaacgcccccaaatcatcgtaattttactgtatgtacaagtaagtccggtacccttgtaggggttttctgactcgtctttctcgtcggacctccgaagtcgtagaccaacgaccggtcccttacccgtcgtaacccgtacttccgtcgtccgggtacctacccggaacgggtcgttacgggaagggtaccggacgggtcgtaacgttactttaacgttacgtacgcgtacgtcttacattacgtcgactaccgactacgactatacggtaccttaagttacgttacggtaccggggacgggtaaccgggaaaccggtagtaccgtaaccggtacccggttacgtacgggtaccgtaccggaccccggtacgtacccggtccccgtacccccgg

SEQ ID NO: 152061 - DNA, 697 bp, Homo sapiens
  misc_feature: GYAE6OF02HCEYV.45.70.G04.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (476)..(476): a, c, t, g, unknown or other
  misc_feature (476)..(476): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacaggcgatcaccatctcctgcactggaaccngcagtcgacgttggttattataactatgtctctggtaccaacaacacccagacaaacgcccccaaactcatgatttangatgtcagtaactcggcctcgagggtttctaagtctcttctctcgtctacctaagtctaggcaacgcggtcccttccgngaacctaatccgtcgtacgggcctaccgaggtcctagggaacgggtacgagggtctaggtaatttaacgttacgtcggtacttcgtccttanaacgtttcaggtaaccgttaagggttaacgttacggttttaacgttttggggttacggtttaccggggacggggtaaccgggtaaaccgtaacgggtacccgttacgggtaaccccggttaaccggttacgggtaccggtaacccggtacccggtaaaccggttcccggtcccgttaccccccggttcgggttaccctaccggtttccctttcccccccgg

SEQ ID NO: 152062 - DNA, 672 bp, Homo sapiens
  misc_feature: GYAE6OF02IETGF.45.70.G04.1.454.CMB.1.raw
  modified_base (159)..(159): a, c, t, g, unknown or other
  misc_feature (159)..(159): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctccctcactcagggcacagggtcctgggcccagtcngccctgactcagcctgcctccgtgtctgggtctccgtggacaggcatccacctatcctctgcactcggaaccgcaggtgtacgtttgttacttataacttatcgtctcctacggtaaccaaacaaccacccaggacaaaccgaccccccaaactcaatagtacttttanagtntgtactaagtaacgtccgcccttcgtacggggtttctagtctacgtcttctcgtcgtcctaccgtaacgtcgtcggaaccaaccgtccggtaccctccctacgacctacgtcctcgtacggtcctaccgcggtcgtacggaggacggtacgtcgttagtacgttaccgttacgtcgacgtaccgtctactacgttacgtccgacgtaccgtacgaacgtaccgtagtaccgtacgttaccgttaaggttccgtacgggacgggtaccggaacgtacgcgtacgtacccgtcggttacgtaccggaccgtaccgtaacggtcccgtacccggtacccccgg

SEQ ID NO: 152063 - DNA, 713 bp, Homo sapiens
  misc_feature: GYAE6OF02JORB3.45.70.G04.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
tcagacgcgatcgacacgaccggtgctcgatttagtgtagtgtgaagggaaaggggggggggtctcaggaggcagcgctctcgggacgtctccaccatggcctgggctctgctattcctcaccctcctcactcagggcacaggggtcctgggcccagtctgcccctgacctcagcctgcctccgtgtctgggtctcctggacaggcatcaccntcctcctgcacgtcggaaccngcagtcgtacgttgttatataactntntctctcgtaccaacaaccaccgaggaccaaacgacccccaaactccatacgtattatgtatgtacagtaactccggtccctacgtggggtttactgtatcgtcttactcgtgccttacgagtccgtaggtaccaacgaccgtcccttcccgtacgtacctacttcgtacggtccgggtacctaccggtacggtcgttacgggaaccgggtacggtacgggtacttacgttaaacgtttacgttaaccgttacgtaccgtacgggtacctaccgtagttaacgtccgacgtacccgtacgtacgtaccgagttaccgttaacgtacgttaagttaccgggtccgggaaacggggtaaccggtaaaccggtaccggtaccgtaccggtaacccgttacggtaccggttaccgaccggtaaccggtaacccggtccttacccccggtacccccgg

SEQ ID NO: 152064 - DNA, 754 bp, Homo sapiens
  misc_feature: GYAE6OF02JPFU1.45.70.G04.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
tcagacgcgatcgacacgaccggtgctcgatttagtgtagtgtgaagggaaaggggggggtcacaagaggcagcgctctcgggacgtctccaccatggcctgggctctgctgctcctcactctcctcactcaggacacagggtcctgggcccaggtctgccctgactcagcctgcctcgtgtcgtggtctcgtggacngtcgatcaccatctcctgcacgtcggaacagcagtgagttgtaggtacttatacttgtcctcgtacggtaccacgngtacaccctagggaacctaaccggccccctaaaacgttctaaacttcggtaatttaagtcggtacgggacctaaggttaaccggaccggttacccttagggtaacgggttttactaaaccgttccgtaccgtttcgtcgttccggtacttaccgtaggtttccgacgggtaccctaaaccggcccgttacccaccccgttagtaaccgtacttacccgtcgaccggggtcctaaccggtccggtaacggttggaccgggaaccggtgggttaccgtacgtttaacggttactttaacgcggttacccgttagtccgtaactaggtttacgacggtaccgttagggtaacgttaaccgttttcgttcgggttaccggttcgaaccgggtacggtactaaggttcccgtacggtacctaccgggtaacgaccggttaacgcccggtacggccgttaccccggtaccgttcggtacctcccgg

SEQ ID NO: 152065 - DNA, 701 bp, Homo sapiens
  misc_feature: GYAE6OF02IB3MC.45.70.G04.1.454.CMB.1.raw
  modified_base (235)..(235): a, c, t, g, unknown or other
  misc_feature (235)..(235): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctcctcactcagggcacagggtcctgggcccagtctcgccctgactcagcctgcctcgtgtctcgggtctccgtggacaggcgatcaccatcctcctgctactcgggaaaccngactaggtcgtaacgtttaggttacttaatactatcgtctcctgtaaccaacaacaccgaggacaaacgacccccaaactcaactacgtattactgtacttagaactaagtaactccggaccctacggtacgggtttactctaacgttcgtcttccgtcgtcgtcctactacgtcgtacgtacgtacgtacccgcctaccgtacgtacctactccgtcgtcggtcctacggtcgtacgtaagacggacggtacggtacgtaattacgttagttaactacgtacgacgtacaatatttaacttacgtttacgttacggtttacctacggttacgggttaccgtcggggaacggtaacgggtaaccgttacggtaccggtaccgttaccgttacgggacctacggacccggtacggtaccgttcccgtacccggttcggtaccctaccggtccttacccgttccccgg

SEQ ID NO: 152066 - DNA, 729 bp, Homo sapiens
  misc_feature: GYAE6OF02I87MT.45.70.G04.1.454.CMB.1.raw
  modified_base (319)..(319): a, c, t, g, unknown or other
  misc_feature (319)..(319): n is a, c, g, or t
tcagacgcgatcgacacgaccggtgctcgatttagtgtagtgtgaagggaaaggggggggggtctcaggaggcagcgctctcgggacgtctccaccatggcctgggctctgctattcctcaccctcctcactcagggcacagggtcctgggcccagtctcgccctgactcagcctgcctccgtgtctgggtcctcctggacaggcgatcaaccatctctgcactggaaccagcagtgacgtttaggttaattaataactagtcgtctctacgtaaccaacaaccaccagacaaaccgaccccaaatacatagtatttangatgtactaagtaacgtccggcccttaggttacgggtttcctagtacgttccgtcctttccgtcgttacgggtaccttaccgtaagttccggtacgaaccgtaaaccgtacccggtcccttaccccgtacgtaacctacttccgtcgtccggggtacctaccggtacgggtcgtaacgggacgggtaacgacgggtacgttacggttaaactttaacgtttacgtagaccgtacgtccttaactaacgtagtcgacgaacgaccgaagtactaacgtacgtacgttaacgttaacgttaccggttccggggaacgggtaacgggaaaccgtacggttaccgtacccggtaacccgttacgtaaccggtaccgacggaccccggtaagtccccggtccccgttacccccgg

SEQ ID NO: 152067 - DNA, 736 bp, Homo sapiens
  misc_feature: GYAE6OF02IYXDZ.45.70.G04.1.454.CMB.1.raw
  modified_base (134)..(134): a, c, t, g, unknown or other
  misc_feature (134)..(134): n is a, c, g, or t
tcagacgcgatcgacacgaccggtgctcgatttagtgtagtgtgaagggaaaggggggggggtctcaggaggcagcgctctcgggacgtctccaccatggcctgggctctgctattcctcaccctcctcacctnagggctacaggggttcctcgggccctagtctcgcccttgactcgagcctgcctccgtgtccgtgggttcctcgtaggacgaggcctataccaccattccgtactggctaacgtcggaaacccgtacgtaggttacgtacggttaggtttaattaacgtaaccttagtcgtccttaccgtacggtaaccaaccaaccgaccgacggtaaccaaacccggaccccctaaagtcaacgttagttaactttacgtacgtagttacgtacgtaacggtaaccgtccggtcccgtagggttacgggtttcaggtaccgtcttacgttcggtacgtccgtacgtaccgttacgtacgtaccgactaaccgtccgaccttccgagtcctagtccgtagtcgtcgtacgtgtcgacggagacggtcacgttagtacgtttacgttcgttcgtacgtccttacgtataaccggtgaaccggttacgacgtcgtaacggtcgggttaacgtcgggtccggtacggacgttaccgggtactcggtccgtaagtaccgtcgaacccgtcggaccgtacgtcccgtacccgttgtaaccctgttaccccttcccgg

SEQ ID NO: 152068 - DNA, 642 bp, Homo sapiens
  misc_feature: GYAE6OF02GA5V2.45.70.G04.1.454.CMB.1.raw
  modified_base (256)..(256): a, c, t, g, unknown or other
  misc_feature (256)..(256): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagacgcgatcgacacgaccggtgctcgatttagtgtagtgtgaagggaaaggggggggggtctcaggaggcagcgctctcgggacgtctccaccatggcctgggctctgctattcctcaccctcctcactcagggcacagggtcctgggcccagtctgccctgactcagcctgcctcgtgtctgggtcctccgtggacaggcatcacatcctcctgcactggaaccagcaggtgacgttaggttaatataactntcgtctctgtaccaacaaccaccagacaaaccgacccctaaactcatgtaatttangtatgtacagtacgtccgtccctaggtggttcngtactcgtcttctcgtcgctactagtctacgacctaaccgacctaccctccgacgtacctacttccgtcgtacgggtccctacggacggtcgtacggacgggagtacgggtctaagtactttaacgtacgtcgactcgtacctacgtaatacgtcgaccgtcgacgtacgctaagtctacgttacgtagttaccggttacgggacgggaacggacctaacgtcccggttaaccggtacccgtaggttaccggccgtaaacccggaccggtaccggttacccctccccgggtaccccg

SEQ ID NO: 152069 - DNA, 732 bp, Homo sapiens
  misc_feature: GYAE6OF02IQPYB.45.70.G04.1.454.CMB.1.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagacgcgatcgacacgaccggtgctcgatttagtgtagtgtgaagggaaaggggggggggtctcaggaggcagcgctctcgggacgtctccaccatggcctgggctctgctattcctcaccctcctcactcgagggcacagggtcctgggcccaggtctgccctgactcagcctgcctccgtgtcgtgggtctccgtggacaggcgactcaccatcctcctgcacgtaggaacccngcaggtcgacgttggttaattataactntcgtctctagtaccaacaaccaccagacaaaccgccccaaactcatgtatttatagatgactaagtaacgtccgtccgtacggtcggggtttctggtatccgtcttcgtcgtcggccttaccgtaacggtcgtacggtactaactaccggtccctcccgtacgacctactcgtccgtcggcctccgagtcgtaagacggacgacggtacgttacgtaatttacgttccgtacgtcgacgtacctagttaacttagtttaaacgttttacgtttaccgttttaccgtaaccgggtttccgggttaacgggttaccggggtacgggtaacccggggtaacgttaacggggtttcccgtaacccgggtttacccggtacggttaccccgggtaaacggccccggttaaccgtcccgtaccccggtaccccgttccggtacctacccgttcccgttaccccgttcccccg

SEQ ID NO: 152070 - DNA, 759 bp, Homo sapiens
  misc_feature: GYAE6OF02HE02M.45.70.G04.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagacgcgatcgacacgaccggtgctcgatttagtgtagtgtgaagggaaagggggggggtctcaggaggcagcgctctcgggacgtctccaccatggcctgggctctgctattcctcaccctcctcactcagggcacgagggtcctgggcccagtctgccctgactcagcctgcatcccgtgtctgggtctccgtggacaggcgatcaccatcctcctgcacgtcggaaccngcagtgacgttggttattaataactntcgtctccgtacggtaccaacaaccaccagaccaaaccgacccccaaactactatagtacttatgtatgtactaagtacgtccgtcccgttacggtacggggtttcgtagtacttcgtcctttcgtctcggcctaccgtaacgttcgtcggaccgtaaccgtacccgtcccttccgtaccgaccttacgttccgttccgtaccgggtcctaccggtcggacgtaggggtaccggaacggtaccgggtacgttacgttaacgtttacttacgtacgtaccgtacgtaccgtacgtaacttcgtacgccgtaacgtccgtagtaccgtacggttacgttaaccttccgttaaacggtttacggggtcccggggtaaaccggggtaacccgggttaaaccggaaccggttccggtaaaccccgggttaccccgggttaccggtaaacccgggtacccgtaacccgggaacccccggttacgggtcccccggttaacccccgg

SEQ ID NO: 152071 - DNA, 263 bp, Homo sapiens
  misc_feature: GYAE6OF01BB0HC.44.38.D05.1.454.CMB.1.raw
  modified_base (254)..(263): a, c, t, g, unknown or other
  misc_feature (254)..(263): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnnnnnnnnn

SEQ ID NO: 152072 - DNA, 296 bp, Homo sapiens
  misc_feature: GYAE6OF01BGHFH.44.38.D05.1.454.CMB.1.raw
  modified_base (261)..(296): a, c, t, g, unknown or other
  misc_feature (261)..(296): n is a, c, g, or t
tcagacagtatatacacgaccggtgctcgatttagtatctgatagttgggtttggggtaggttgcattactactactacggtatggacgtctggggccaagggaccacggtcaaccgtactcctcagcttccaccaagggcccatcggtcttccccctggcgccctgctccaggagcacctctggggcacagcggccctgggctgcctggtcaaggactacttcctatatactgtctgagcgggctggcaaggcgcatagnnnnnnnnnnnnnnnnnnnnnnnnnnnnnnnnnnnn

SEQ ID NO: 152073 - DNA, 244 bp, Homo sapiens
  misc_feature: GYAE6OF01EDPUY.44.38.D05.1.454.CMB.1.raw
  modified_base (242)..(244): a, c, t, g, unknown or other
  misc_feature (242)..(244): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacgtctgagcgggctggcaaggcgcatagnnn

SEQ ID NO: 152074 - DNA, 256 bp, Homo sapiens
  misc_feature: GYAE6OF01AE57Q.44.38.D05.1.454.CMB.1.raw
  modified_base (254)..(256): a, c, t, g, unknown or other
  misc_feature (254)..(256): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnn

SEQ ID NO: 152075 - DNA, 257 bp, Homo sapiens
  misc_feature: GYAE6OF01BF63L.44.38.D05.1.454.CMB.1.raw
  modified_base (254)..(257): a, c, t, g, unknown or other
  misc_feature (254)..(257): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnnn

SEQ ID NO: 152076 - DNA, 193 bp, Homo sapiens
  misc_feature: GYAE6OF01CI2AN.44.38.D05.1.454.CMB.1.raw
  modified_base (192)..(193): a, c, t, g, unknown or other
  misc_feature (192)..(193): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnn

SEQ ID NO: 152077 - DNA, 291 bp, Homo sapiens
  misc_feature: GYAE6OF01DCE82.44.38.D05.1.454.CMB.1.raw
  modified_base (260)..(291): a, c, t, g, unknown or other
  misc_feature (260)..(291): n is a, c, g, or t
tcagacagtatatacacgaccggtgctcgatttagtatctgatagttgggtttgggtgagttgcatactactactacggtatggacgtctggggccgaacgggaccacggtcaccgtctccgtcagcttccaccaagggcccatcggtcttcccctggcgccctgctccaggagcacctctggggcacagcggccctgggctgcctggtcaaggactacttcctcgatcgcgtctgagccgggctggcaaggcgcatagnnnnnnnnnnnnnnnnnnnnnnnnnnnnnnnn

SEQ ID NO: 152078 - DNA, 529 bp, Homo sapiens
  misc_feature: GYAE6OF01CMH0W.44.38.D05.1.454.CMB.1.raw
  modified_base (460)..(460): a, c, t, g, unknown or other
  misc_feature (460)..(460): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactcgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctgggccaagggaccacggtcaccgtctcctcagcttccaccaacgggccatcggtccttcccctggccgccctgcctccaggacncacctcgtggggcacgagccggcccgtgggcctgccgtcggtcaacggactacttcctatactctgtcg

SEQ ID NO: 152079 - DNA, 199 bp, Homo sapiens
  misc_feature: GYAE6OF01BMVRJ.44.38.D05.1.454.CMB.1.raw
  modified_base (191)..(199): a, c, t, g, unknown or other
  misc_feature (191)..(199): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgcctcctctatatactgtctgagcgggctggcaaggcgcatagnnnnnnnnn

SEQ ID NO: 152080 - DNA, 192 bp, Homo sapiens
  misc_feature: GYAE6OF01AEP9T.44.38.D05.1.454.CMB.1.raw
  modified_base (192)..(192): a, c, t, g, unknown or other
  misc_feature (192)..(192): n is a, c, g, or t
tcagacagtatatacacgaccggtgctcgatttagtatctgatagttgggtttgggatagtagtagtgatcatcaggtgttcggcggagggaccaagctgaccgtcctaggtcagcccaaggctgccccctcggtcactctgttcccgccctcctctatatactgtctgagcgggctggcaaggcgcatagn

SEQ ID NO: 152081 - DNA, 200 bp, Homo sapiens
  misc_feature: GYAE6OF01DUT3A.44.38.D05.1.454.CMB.1.raw
  modified_base (192)..(200): a, c, t, g, unknown or other
  misc_feature (192)..(200): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnnnnnnnnn

SEQ ID NO: 152082 - DNA, 138 bp, Homo sapiens
  misc_feature: GYAE6OF01C09OA.44.38.D05.1.454.CMB.1.raw
  modified_base (138)..(138): a, c, t, g, unknown or other
  misc_feature (138)..(138): n is a, c, g, or t
tcagacagtatatacacgaccggtgctcgatttagtatctgatagttgggtttggggcaggtggcacagcggccctgggctgcctggtcaaggactacttcctatatactgtctgagcgggctggcaaggcgcatagn

SEQ ID NO: 152083 - DNA, 219 bp, Homo sapiens
  misc_feature: GYAE6OF01BLIT6.44.38.D05.1.454.CMB.1.raw
  modified_base (217)..(219): a, c, t, g, unknown or other
  misc_feature (217)..(219): n is a, c, g, or t
tcagacagtatatacacgaccggtgctcgatttagtatctgatagttgggtttgggccaagggaccacggtcaccgtctcctcagcttccaccaagggccatcggtcttcccctggcgccctgctccaggagcacctctggggcacagcggccctgggctgcctggtcaaggactacttcctatatactgtctgagcgggctggcaaggcgcatagnnn

SEQ ID NO: 152084 - DNA, 314 bp, Homo sapiens
  misc_feature: GYAE6OF01ENXK6.44.38.D05.1.454.CMB.1.raw
  modified_base (147)..(147): a, c, t, g, unknown or other
  misc_feature (147)..(147): n is a, c, g, or t
  modified_base (262)..(266): a, c, t, g, unknown or other
  misc_feature (262)..(266): n is a, c, g, or t
  modified_base (268)..(314): a, c, t, g, unknown or other
  misc_feature (268)..(314): n is a, c, g, or t
tcagacagtatatacacgaccggtgctcgatttagtatctgatagttgggtttggggagttgcatactactactacggtatggacgtctggggcccaagggaccacggtcaccgtctcctcagcttccaccaagggcccatccggtnttccccctggcgccctgctccaggagcacctctgggggcacagcggccctgggctgctggtcgaaggacgtacttcctactatactgtcgtgagcgggcgtgcaggacgcatagnnnnnannnnnnnnnnnnnnnnnnnnnnnnnnnnnnnnnnnnnnnnnnnnnnn

SEQ ID NO: 152085 - DNA, 258 bp, Homo sapiens
  misc_feature: GYAE6OF01DS7K4.44.38.D05.1.454.CMB.1.raw
  modified_base (257)..(258): a, c, t, g, unknown or other
  misc_feature (257)..(258): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnn

SEQ ID NO: 152086 - DNA, 257 bp, Homo sapiens
  misc_feature: GYAE6OF01B8WKV.44.38.D05.1.454.CMB.1.raw
  modified_base (257)..(257): a, c, t, g, unknown or other
  misc_feature (257)..(257): n is a, c, g, or t
tcagacagtatatacacgaccggtgctcgatttagtatctgatagttgggttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagn

SEQ ID NO: 152087 - DNA, 318 bp, Homo sapiens
  misc_feature: GYAE6OF01EZAJS.44.38.D05.1.454.CMB.1.raw
  modified_base (308)..(318): a, c, t, g, unknown or other
  misc_feature (308)..(318): n is a, c, g, or t
tcagacagtatatacacgaccggtgctcgatttagtatctgatagttgggtttgggcaccgaggacacggctgtgtattactgtgcaagagccggtgcgggagttcgggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagnnnnnnnnnnn

SEQ ID NO: 152088 - DNA, 257 bp, Homo sapiens
  misc_feature: GYAE6OF01AWAQN.44.38.D05.1.454.CMB.1.raw
  modified_base (254)..(257): a, c, t, g, unknown or other
  misc_feature (254)..(257): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttcccctggcgccctgctccaggagcacctctggggcacagcggccctgggctgcctggtcaaggactacttccacgtctactgctgagcgggctggcaaggcgcatagnnnn

SEQ ID NO: 152089 - DNA, 257 bp, Homo sapiens
  misc_feature: GYAE6OF01EMAMX.44.38.D05.1.454.CMB.1.raw
  modified_base (255)..(257): a, c, t, g, unknown or other
  misc_feature (255)..(257): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 152090 - DNA, 239 bp, Homo sapiens
  misc_feature: GYAE6OF01C8UTK.44.38.D05.1.454.CMB.1.raw
  modified_base (235)..(239): a, c, t, g, unknown or other
  misc_feature (235)..(239): n is a, c, g, or t
tcagacagtatatacacgaccggtgctcgatttagtatctgatagttgggtttgggagcttgagtcctggggccagggaaccctggtcaccgtctcgtcagcctccaccaagggcccatcggtcttcccctggcgccctgctccaggagcacctccgagagcacagcggccctgggctgcctggtcaaggactacttcctatatactgtctgagcgggctggcaaggcgcatagnnnnn

SEQ ID NO: 152091 - DNA, 192 bp, Homo sapiens
  misc_feature: GYAE6OF01EA1GX.44.38.D05.1.454.CMB.1.raw
  modified_base (192)..(192): a, c, t, g, unknown or other
  misc_feature (192)..(192): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagn

SEQ ID NO: 152092 - DNA, 142 bp, Homo sapiens
  misc_feature: GYAE6OF01ETBVV.44.38.D05.1.454.CMB.1.raw
  modified_base (140)..(142): a, c, t, g, unknown or other
  misc_feature (140)..(142): n is a, c, g, or t
tcagacagtatatacacgaccggtgctcgatttagtatctgatagttgggtttgggggcaggtgggcacagcggccctgggctgcctggtcaaggactacttccacgtctactgctgagcgggctggcaaggcgcatagnnn

SEQ ID NO: 152093 - DNA, 285 bp, Homo sapiens
  misc_feature: GYAE6OF01EJ140.44.38.D05.1.454.CMB.1.raw
  modified_base (258)..(285): a, c, t, g, unknown or other
  misc_feature (258)..(285): n is a, c, g, or t
tcagacagtatatacacgaccggtgctcgatttagtatctgatagttggggtttaggggaggttgcatactactaactacggtatggacgtctggggccaagggaccacggtcaccgtctcctcacgcttccaccaaggcccatcgtcttcccctggcgccctgctccaggagcacctctggggcacagcggccctgggctgcctggtcaaggactacttcctatatactgtctgagcgggctggcaaggcgcatagnnnnnnnnnnnnnnnnnnnnnnnnnnnn

SEQ ID NO: 152094 - DNA, 159 bp, Homo sapiens
  misc_feature: GYAE6OF01CQ9J5.44.38.D05.1.454.CMB.1.raw
  modified_base (159)..(159): a, c, t, g, unknown or other
  misc_feature (159)..(159): n is a, c, g, or t
tcagacagtatatacacgaccggtgctcgatttagtatctgatagttgggtttggggaggtgtgtcacaagatttgggctctgggcacagcggccctgggctgcctggtcaaggactacttcctcgatcgcgtctgagcgggctggcaaggcgcatagn

SEQ ID NO: 152095 - DNA, 262 bp, Homo sapiens
  misc_feature: GYAE6OF01CZBQT.44.38.D05.1.454.CMB.1.raw
  modified_base (256)..(262): a, c, t, g, unknown or other
  misc_feature (256)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnn

SEQ ID NO: 152096 - DNA, 201 bp, Homo sapiens
  misc_feature: GYAE6OF01BL2AG.44.38.D05.1.454.CMB.1.raw
  modified_base (191)..(201): a, c, t, g, unknown or other
  misc_feature (191)..(201): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgcccctcggtcactctgttcccgccctcctctatatactgtctgagcgggctggcaaggcgcatagnnnnnnnnnnn

SEQ ID NO: 152097 - DNA, 193 bp, Homo sapiens; identical to SEQ ID NO: 152076
  misc_feature: GYAE6OF01CV3J4.44.38.D05.1.454.CMB.1.raw
  modified_base (192)..(193): a, c, t, g, unknown or other
  misc_feature (192)..(193): n is a, c, g, or t

SEQ ID NO: 152098 - DNA, 261 bp, Homo sapiens
  misc_feature: GYAE6OF01CYDA3.44.38.D05.1.454.CMB.1.raw
  modified_base (256)..(261): a, c, t, g, unknown or other
  misc_feature (256)..(261): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnnnn

SEQ ID NO: 152099 - DNA, 260 bp, Homo sapiens
  misc_feature: GYAE6OF01BZX1D.44.38.D05.1.454.CMB.1.raw
  modified_base (257)..(260): a, c, t, g, unknown or other
  misc_feature (257)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnn

SEQ ID NO: 152100 - DNA, 263 bp, Homo sapiens
  misc_feature: GYAE6OF01C18RU.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctggggcacagcggccctgggctgccttggtcaaggactacttcctatatactgtctgagcgggctggcaaggcgcatagnnnnnnnn

SEQ ID NO: 152101 - DNA, 194 bp, Homo sapiens
  misc_feature: GYAE6OF01EFIJR.44.38.D05.1.454.CMB.1.raw
  modified_base (192)..(194): a, c, t, g, unknown or other
  misc_feature (192)..(194): n is a, c, g, or t
tcagacagtatatacacgaccggtgctcgatttagtatctgatagttgggtgtgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnnn

SEQ ID NO: 152102 - DNA, 259 bp, Homo sapiens
  misc_feature: GYAE6OF01ASOEU.44.38.D05.1.454.CMB.1.raw
  modified_base (257)..(259): a, c, t, g, unknown or other
  misc_feature (257)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnn

SEQ ID NO: 152103 - DNA, 253 bp, Homo sapiens
  misc_feature: GYAE6OF01DDBLL.44.38.D05.1.454.CMB.1.raw
  modified_base (252)..(253): a, c, t, g, unknown or other
  misc_feature (252)..(253): n is a, c, g, or t
tcagacagtatatacacgaccggtgctcgatttagtatctgatagttgggtttgggacagacttcactctcagcatcagcggactggagcctgaggattctgcagtttattactgtcagcagtatggttggtcacctctgacgttcggccaagggaccaaggtggaaatcaaacgaactgtgactgcaccatctgtcttcatcttccgccatctgatatatactgtctgagcgggctggcaaggcgcatagnn

SEQ ID NO: 152104 - DNA, 259 bp, Homo sapiens
  misc_feature: GYAE6OF01C4MIK.44.38.D05.1.454.CMB.1.raw
  modified_base (257)..(259): a, c, t, g, unknown or other
  misc_feature (257)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccacgtctactgctgagcgggctggcaaggcgcatagnnn

SEQ ID NO: 152105 - DNA, 260 bp, Homo sapiens
  misc_feature: GYAE6OF01C8CGY.44.38.D05.1.454.CMB.1.raw
  modified_base (256)..(260): a, c, t, g, unknown or other
  misc_feature (256)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagnnnnn

SEQ ID NO: 152106 - DNA, 260 bp, Homo sapiens; identical to SEQ ID NO: 152099
  misc_feature: GYAE6OF01EE356.44.38.D05.1.454.CMB.1.raw
  modified_base (257)..(260): a, c, t, g, unknown or other
  misc_feature (257)..(260): n is a, c, g, or t

SEQ ID NO: 152107 - DNA, 262 bp, Homo sapiens
  misc_feature: GYAE6OF01CMGTD.44.38.D05.1.454.CMB.1.raw
  modified_base (257)..(262): a, c, t, g, unknown or other
  misc_feature (257)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnn

SEQ ID NO: 152108 - DNA, 298 bp, Homo sapiens
  misc_feature: GYAE6OF01BBTV8.44.38.D05.1.454.CMB.1.raw
  modified_base (297)..(298): a, c, t, g, unknown or other
  misc_feature (297)..(298): n is a, c, g, or t
tcagacagtatatacacgaccggtgctcgatttagtatctgatagttgggtttgggcaccgaggacacggctgtgtattactgtgcgaccatatcagcgcctggagtccgttctgagtacttccaagattggggccagggcaccctggtcaccgtcgcctcagcctccaccaagggcccatcggtcttcccctggcgccctgctccaggagcacctccgagagcacagcggccctgggctgcctggtcaaggactacttcctatatactgtctgagcgggctggcaaggcgcatagnn

SEQ ID NO: 152109 - DNA, 258 bp, Homo sapiens
  misc_feature: GYAE6OF01EZSFS.44.38.D05.1.454.CMB.1.raw
  modified_base (256)..(258): a, c, t, g, unknown or other
  misc_feature (256)..(258): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnn

SEQ ID NO: 152110 - DNA, 258 bp, Homo sapiens
  misc_feature: GYAE6OF01CZGDJ.44.38.D05.1.454.CMB.1.raw
  modified_base (255)..(258): a, c, t, g, unknown or other
  misc_feature (255)..(258): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctataactgtctgagcgggctggcaaggcgcatagnnnn

SEQ ID NO: 152111 - DNA, 313 bp, Homo sapiens
  misc_feature: GYAE6OF01D7K7P.44.38.D05.1.454.CMB.1.raw
  modified_base (309)..(313): a, c, t, g, unknown or other
  misc_feature (309)..(313): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagnnnnn

SEQ ID NO: 152112 - DNA, 159 bp, Homo sapiens
  misc_feature: GYAE6OF01DMKYP.44.38.D05.1.454.CMB.1.raw
  modified_base (158)..(159): a, c, t, g, unknown or other
  misc_feature (158)..(159): n is a, c, g, or t
tcagacagtatatacacgaccggtgctcgatttagtatctgatagttgggtttggggaggtgtgtcacaagatttgggctctgggcacagcggccctgggctgcctggtcaaggactacttcctatatactgtctgagcggctggcaaggcgcatagnn

SEQ ID NO: 152113 - DNA, 254 bp, Homo sapiens
  misc_feature: GYAE6OF01CYO26.44.38.D05.1.454.CMB.1.raw
  modified_base (236)..(254): a, c, t, g, unknown or other
  misc_feature (236)..(254): n is a, c, g, or t
tcagacagtatatacacgaccggtgctcgatttagtatctgatagttgggttttgggggagcttgagtcctggggccagggaaccctggtcaccgtctcgtcagcctccaccaagggcccatcggtcttcccctggcgccctgctcaggagcacctccgagagcacagcggccctgggctgcctggtcaaggctacttcctatatactgtctgagcgggctggcaaggcgcatagnnnnnnnnnnnnnnnnnnn

SEQ ID NO: 152114 - DNA, 222 bp, Homo sapiens
  misc_feature: GYAE6OF01ETGPG.44.38.D05.1.454.CMB.1.raw
  modified_base (220)..(222): a, c, t, g, unknown or other
  misc_feature (220)..(222): n is a, c, g, or t
tcagacagtatatacacgaccggtgctcgatttagtatctgatagttgggtttggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 152115 - DNA, 328 bp, Homo sapiens
  misc_feature: GYAE6OF01AGOB2.44.38.D05.1.454.CMB.1.raw
  modified_base (281)..(328): a, c, t, g, unknown or other
  misc_feature (281)..(328): n is a, c, g, or t
tcagacagtatatacacgaccggtgctcgatttagtatctgatagttgggtttgggggagttgcatactactactacggtatggacgtctggggccaagggaccacggtcaccgtctcctcagcttccaccaagggcccatcggtcttccccctggcgccctgctccaggagcaccctcgtcggggcacagccggccccgtgggctcgccttggtcgaacggaccttaccgttcctacgatccgccgttcctggaggccgggctggcaaggcgctataggnnnnnnnnnnnnnnnnnnnnnnnnnnnnnnnnnnnnnnnnnnnnnnnn

SEQ ID NO: 152116 - DNA, 279 bp, Homo sapiens
  misc_feature: GYAE6OF01BNPXJ.44.38.D05.1.454.CMB.1.raw
  modified_base (251)..(251): a, c, t, g, unknown or other
  misc_feature (251)..(251): n is a, c, g, or t
  modified_base (257)..(279): a, c, t, g, unknown or other
  misc_feature (257)..(279): n is a, c, g, or t
tcagacagtatatacacgaccggtgctcgatttagtatctgatagttgggtttggggaagaggaagactgacggtcctcccaggagttcaggtgctgggcaccttgggcacggggaggtgtgtcacaagatttgggctctgggcaccgtggcatggggagtgtgtcacaagatttgggctctgggcacagcggccctgggctgcctggtcaaggctacttcctcgatcgcgtctgagcggctggcaaggcncatagnnnnnnnnnnnnnnnnnnnnnnn

SEQ ID NO: 152117 - DNA, 260 bp, Homo sapiens; identical to SEQ ID NO: 152099
  misc_feature: GYAE6OF01DNZ93.44.38.D05.1.454.CMB.1.raw
  modified_base (257)..(260): a, c, t, g, unknown or other
  misc_feature (257)..(260): n is a, c, g, or t

SEQ ID NO: 152118 - DNA, 140 bp, Homo sapiens
  misc_feature: GYAE6OF01A9ZMF.44.38.D05.1.454.CMB.1.raw
  modified_base (139)..(140): a, c, t, g, unknown or other
  misc_feature (139)..(140): n is a, c, g, or t
tcagacagtatatacacgaccggtgctcgatttagtatctgatagttgggtttggggcaggtgggcacagcggccctgggctgcctggtcaaggactacttcctcgatcgcgtctgagcgggctggcaaggcgcatagnn

SEQ ID NO: 152119 - DNA, 265 bp, Homo sapiens
  misc_feature: GYAE6OF01BAGNK.44.38.D05.1.454.CMB.1.raw
  modified_base (257)..(265): a, c, t, g, unknown or other
  misc_feature (257)..(265): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnn

SEQ ID NO: 152120 - DNA, 259 bp, Homo sapiens
  misc_feature: GYAE6OF01CZ7HV.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 152121 - DNA, 222 bp, Homo sapiens; identical to SEQ ID NO: 152114
  misc_feature: GYAE6OF01EAXLJ.44.38.D05.1.454.CMB.1.raw
  modified_base (220)..(222): a, c, t, g, unknown or other
  misc_feature (220)..(222): n is a, c, g, or t

SEQ ID NO: 152122 - DNA, 236 bp, Homo sapiens
  misc_feature: GYAE6OF01B76JZ.44.38.D05.1.454.CMB.1.raw
  modified_base (218)..(236): a, c, t, g, unknown or other
  misc_feature (218)..(236): n is a, c, g, or t
tcagacagtatatacacgaccggtgctcgatttagtatctgatagttagggtttgggcccaagggaccacggtcaccgtctcctcagcttccaccaaggcccatcggtcttcccctggcgccctgctccaggagcacctctgggggcacagcgccctgggctgcctggtcaaggactacttccacgtctactgctgagcggctggcaaggcgcatagnnnnnnnnnnnnnnnnnnn

SEQ ID NO: 152123 - DNA, 552 bp, Homo sapiens
  misc_feature: GYAE6OF01DWTGX.44.38.D05.1.454.CMB.1.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
tcagacagtatatacacgaccggtgctcgatttagtatctgatagttgggtttggggagttaggcgatacgtacgtactacggtaatggacggtctgggccaagggacacggtcacgtctcctcagtcttccaccaaggccatcggtcttcccctggcgccctgctccaggagcacctctggggcacagcgccctgggctgcctggtccaaggactacttccgtatatactgtactgagtcgggctggacaaggccgtcactagntatgtgancngcatagcagctagccagatgcanananagagagacgacgtagagacgtcacgacgncgnctcgtacgtcgtacgtcgcnctacgtcgtcgcgacgacgctcncgtgtagtactactactacgtacgtacgtacgacgagagcgacgcgacgtacgtacgtactacgtagtacgtacgacgtacgtactactacgtacgactacgtacgtacgtacgtacgtacgacgtacgtacgtacgtcggacgtacgtacgtacgtacgacgacgacgcgtacg

SEQ ID NO: 152124 - DNA, 259 bp, Homo sapiens
  misc_feature: GYAE6OF01AXUQP.44.38.D05.1.454.CMB.1.raw
  modified_base (257)..(259): a, c, t, g, unknown or other
  misc_feature (257)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnn

SEQ ID NO: 152125 - DNA, 263 bp, Homo sapiens
  misc_feature: GYAE6OF01B88E1.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnn

SEQ ID NO: 152126 - DNA, 317 bp, Homo sapiens
  misc_feature: GYAE6OF01D81ZJ.44.38.D05.1.454.CMB.1.raw
  modified_base (309)..(317): a, c, t, g, unknown or other
  misc_feature (309)..(317): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnnnnnnn

SEQ ID NO: 152127 - DNA, 260 bp, Homo sapiens
  misc_feature: GYAE6OF01B6JAR.44.38.D05.1.454.CMB.1.raw
  modified_base (256)..(260): a, c, t, g, unknown or other
  misc_feature (256)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnnn

SEQ ID NO: 152128 - DNA, 263 bp, Homo sapiens
  misc_feature: GYAE6OF01EP268.44.38.D05.1.454.CMB.1.raw
  modified_base (257)..(263): a, c, t, g, unknown or other
  misc_feature (257)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnn

SEQ ID NO: 152129 - DNA, 557 bp, Homo sapiens
  misc_feature: GYAE6OF01DFIIN.44.38.D05.1.454.CMB.1.raw
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattacngtgcaagngccggtgcgggaggttcggggagttgcatactactactacggtatggacgtcgtgggccaagggaccacggtcaccgtctcctcagcttccaccaacgggcccacgtccggtccttcccccgtggcccgccctcgcctccgacggacgccacccgtcgtcgggggaccg

SEQ ID NO: 152130 - DNA, 253 bp, Homo sapiens; identical to SEQ ID NO: 152103
  misc_feature: GYAE6OF01DAFG9.44.38.D05.1.454.CMB.1.raw
  modified_base (252)..(253): a, c, t, g, unknown or other
  misc_feature (252)..(253): n is a, c, g, or t

SEQ ID NO: 152131 - DNA, 313 bp, Homo sapiens
  misc_feature: GYAE6OF01DC7QP.44.38.D05.1.454.CMB.1.raw
  modified_base (310)..(313): a, c, t, g, unknown or other
  misc_feature (310)..(313): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcaccctcctccaagagcacctctgggggcacagcggccctgggctgcctggtcaaggactacttcctatatactgtctgagcgggctggcaaggcgcatagnnnn

SEQ ID NO: 152132 - DNA, 561 bp, Homo sapiens
  misc_feature: GYAE6OF01BMGFZ.44.38.D05.1.454.CMB.1.raw
  modified_base (326)..(326): a, c, t, g, unknown or other
  misc_feature (326)..(326): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagngccggtgcgggagttcggggattgcatactactactacggtatggacgtcgtggggccaagggaccacggtcaccgtctcctcagcttccaccaacggcccatcggtcttcccccgtggccgccctgcctccaggacgccacccgtcgtcggggccacgacggccggcccgtcgggctcggcccgtcgggtccgaaacgggaccttaccgttcccttaccgacgtccgcggtccg

SEQ ID NO: 152133 - DNA, 277 bp, Homo sapiens
  misc_feature: GYAE6OF01AR6FP.44.38.D05.1.454.CMB.1.raw
  modified_base (258)..(277): a, c, t, g, unknown or other
  misc_feature (258)..(277): n is a, c, g, or t
tcagacagtatatacacgaccggtgctcgatttagtatctgatagttggggtttggggagttgcatactactactatggtatggacgtctggggccaagggaccacggtcaccgtctcctcagcttccaccaagggcccatcggtcttccccctggcgccctgctccaggagcacctcctggggcacagcggccctgggctgcctggtcaagggctacttcctatatactgtctgagcgggctggcaaggcgcatagnnnnnnnnnnnnnnnnnnnn

SEQ ID NO: 152134 - DNA, 225 bp, Homo sapiens
  misc_feature: GYAE6OF01DERSK.44.38.D05.1.454.CMB.1.raw
  modified_base (218)..(225): a, c, t, g, unknown or other
  misc_feature (218)..(225): n is a, c, g, or t
tcagacagtatatacacgaccggtgctcgatttagtatctgatagttgggtttggggccaagggaccacggtcaccgtcgtcctcagcttccaccaaggcccatcggtcttcccctggcgccctgctccacggagcacctctggggcacagcgccctgggctgcctggtcaaggctacttccacgtctactgctgagcggctggcaaggcgcgatagnnnnnnnn

SEQ ID NO: 152135 - DNA, 685 bp, Homo sapiens
  misc_feature: GYAE6OF01BHH2D.44.38.D05.1.454.CMB.1.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccgagggagggctggtgtgggtctcacgtattaatagtgagtgggagtagcaacaagctacgcggactcgngaaggccattcaccatctcagacgacaacgcaagaacacgctgtatctagacaaatgaacagtctagagacgccgaggaccacggctgtgtacttacgngtagacaagcggccggtggacgggtagttcggggattgactagttaacctacgtacgtacggtagtacggaccgttcgtacggggaccgaacgggcccgtaacggtccgtaccgttcgtccctacgtaacgtcccgttaacccgaacgtaacccgggtccctaacgttcccgttcccgttacccccggtcggacccgtccccgttcgccccgtaccggacgggaccgtaccgtaccggtaccggtcggggacctaaccggcgggtcccggcccggttcgggccttaccggtcccggttaccgggacgtaaacgggttaccccttacgttacccgttaagtttaccgttacggtcgttaccggg

SEQ ID NO: 152136 - DNA, 260 bp, Homo sapiens; identical to SEQ ID NO: 152099
  misc_feature: GYAE6OF01DS4F3.44.38.D05.1.454.CMB.1.raw
  modified_base (257)..(260): a, c, t, g, unknown or other
  misc_feature (257)..(260): n is a, c, g, or t

SEQ ID NO: 152137 - DNA, 278 bp, Homo sapiens
  misc_feature: GYAE6OF01BIJLK.44.38.D05.1.454.CMB.1.raw
  modified_base (263)..(278): a, c, t, g, unknown or other
  misc_feature (263)..(278): n is a, c, g, or t
tcagacagtatatacacgaccggtgctcgatttagtatctgatagttggggtttggggagttgcatactactactacggtatggacgtctggggccaagggaccacggtcaccgtctcctcagcttccaccaagggcccatcggtcttccccctggcgcccttgctccaggagcacctctgggggcacacgcggccctgggcgtgcctggtcaaggactacttcctatatacgtgtctgagcgggctggcgaaggcgcatagnnnnnnnnnnnnnnnn

SEQ ID NO: 152138 - DNA, 262 bp, Homo sapiens; identical to SEQ ID NO: 152107
  misc_feature: GYAE6OF01AWGTD.44.38.D05.1.454.CMB.1.raw
  modified_base (257)..(262): a, c, t, g, unknown or other
  misc_feature (257)..(262): n is a, c, g, or t

SEQ ID NO: 152139 - DNA, 313 bp, Homo sapiens
  misc_feature: GYAE6OF01CQA5Q.44.38.D05.1.454.CMB.1.raw
  modified_base (310)..(313): a, c, t, g, unknown or other
  misc_feature (310)..(313): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccatcaagggcccatcggtcttccccctggcgccctgctccaggagcacctctgggggcacagcggccctgggctgcctggtcaaggactacttcctcgatcgcgtctgagcgggctggcaaggcgcatagnnnn

SEQ ID NO: 152140 - DNA, 262 bp, Homo sapiens; identical to SEQ ID NO: 152107
  misc_feature: GYAE6OF01D0QHT.44.38.D05.1.454.CMB.1.raw
  modified_base (257)..(262): a, c, t, g, unknown or other
  misc_feature (257)..(262): n is a, c, g, or t

SEQ ID NO: 152141 - DNA, 325 bp, Homo sapiens
  misc_feature: GYAE6OF01C60YF.44.38.D05.1.454.CMB.1.raw
  modified_base (311)..(325): a, c, t, g, unknown or other
  misc_feature (311)..(325): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctcgtgggggcacagccggccctgggctgcctggtcaaggactacttcctatatactgtctgagcggctggcaaggcgcatagnnnnnnnnnnnnnnn

SEQ ID NO: 152142 - DNA, 351 bp, Homo sapiens
  misc_feature: GYAE6OF01BSLBD.44.38.D05.1.454.CMB.1.raw
  modified_base (316)..(318): a, c, t, g, unknown or other
  misc_feature (316)..(318): n is a, c, g, or t
  modified_base (320)..(335): a, c, t, g, unknown or other
  misc_feature (320)..(335): n is a, c, g, or t
  modified_base (337)..(351): a, c, t, g, unknown or other
  misc_feature (337)..(351): n is a, c, g, or t
tcagacagtatatacacgaccggtgctcgatttagtatctgatagttgggtttgggcaccgaggacacggctgtgtattactgtcgcaacgagccggtgcgggagtttcggggagttgcatactactactacggtatggacgtctgggggccaagggaccacggtcaccgtctcctcagcttccaccaagggcccattcggtcttccccctggcgccctgctccaggagcacctcgtgggggcacaggccggccctgggctgcctggtcaaggctacttctatatactgtctgagcgggctggcaaggcgcatagnnngnnnnnnnnnnnnnnnnannnnnnnnnnnnnnn

SEQ ID NO: 152143 - DNA, 161 bp, Homo sapiens
  misc_feature: GYAE6OF01BK2J4.44.38.D05.1.454.CMB.1.raw
  modified_base (160)..(161): a, c, t, g, unknown or other
  misc_feature (160)..(161): n is a, c, g, or t
tcagacagtatatacacgaccggtgctcgatttagtatctgatagttgggtttgggggaggtgtgtcacaagatttgggctctgggcacagcggccctgggctgcctggtcaaggactacttcctatatactgtctgagcgggctggcaaggcgcatagnn

SEQ ID NO: 152144 - DNA, 261 bp, Homo sapiens
  misc_feature: GYAE6OF01CPK15.44.38.D05.1.454.CMB.1.raw
  modified_base (258)..(261): a, c, t, g, unknown or other
  misc_feature (258)..(261): n is a, c, g, or t
tcagacagtatatacacgaccggtgctcgatttagtatctgatagttggggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnn

SEQ ID NO: 152145 - DNA, 524 bp, Homo sapiens
  misc_feature: GYAE6OF01BCADR.44.38.D05.1.454.CMB.1.raw
  modified_base (515)..(516): a, c, t, g, unknown or other
  misc_feature (515)..(516): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggattatcgtttgggcccacactggggccagggaaccttggtcgtcgtctcctcagcttccacagggcccatcgtcttcccctggcgccctgctccaggagcacctctgggggcacgagcggccctgggctgcctggtcaaggctacgtccagtctactgctgcgcgggnnggcaggcg

SEQ ID NO: 152146 - DNA, 141 bp, Homo sapiens
  misc_feature: GYAE6OF01ESKPV.44.38.D05.1.454.CMB.1.raw
  modified_base (140)..(141): a, c, t, g, unknown or other
  misc_feature (140)..(141): n is a, c, g, or t
tcagacagtatatacacgaccggtgctcgatttagtatctgatagttgggtttgggggcaggtgggcacagcggccctgggctgcctggtcaaggactacttcctatatactgtctgagcgggctggcaaggcgcatagnn

SEQ ID NO: 152147 - DNA, 191 bp, Homo sapiens
  misc_feature: GYAE6OF01DHYU8.44.38.D05.1.454.CMB.1.raw
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatag

SEQ ID NO: 152148 - DNA, 571 bp, Homo sapiens
  misc_feature: GYAE6OF01EQTYC.44.38.D05.1.454.CMB.1.raw
  modified_base (256)..(257): a, c, t, g, unknown or other
  misc_feature (256)..(257): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagacagtatatacacgaccggtgctcgattttagtatctgatagttggggtttgggggagttgcatactactactacggtatggacgtctggggccaagggaccacggtcaccgtctcctcagcttccaccaaggccatcggtcttcccctggcgcctgctccaggagctacctcgtggggcacagcggcctggctgctggtcaggactacgttccatatacgtgtctgacgcgggctggctaaggcgcatagnngncgnatatctagtctgagctnancnggcacngncgcgtgctgctgganacganacgagtacgagtgagtacgagagtcgtagcgngtagtagtcgtacgtacgtacgtactactactacgacacgtacgacgacgacgtacgtacgtacgtacgtacgtagtacgtacgtacgtacgtacgtacgtacgtacgtacgtacgtacgtacgtacgtacgtacgtacgtacgtacgtacgtacgtacgtacgtacgacggacgtaggtacggtcgtacgtacgtacggtacggtacggtacgtacgtcgtcgtacg

SEQ ID NO: 152149 - DNA, 263 bp, Homo sapiens
  misc_feature: GYAE6OF01EXNWL.44.38.D05.1.454.CMB.1.raw
  modified_base (258)..(263): a, c, t, g, unknown or other
  misc_feature (258)..(263): n is a, c, g, or t
tcagacagtatatacacgaccggtgctcgatttagtatctgatagttgggtttaggggagttgcatactactactacggtatggacgtctggggccaagggaccacggtcaccgtctcctcagcttccaccaagggcccatcggtcttccccctggcaccctcctccaagagcacctctgggggcacagcggccctgggctgcctggtcaaggactacttcctatatactgtctgagcgggctggcaaggcgcatagnnnnnn

SEQ ID NO: 152150 - DNA, 537 bp, Homo sapiens
  misc_feature: GYAE6OF01C02K1.44.38.D05.1.454.CMB.1.raw
  modified_base (324)..(324): a, c, t, g, unknown or other
  misc_feature (324)..(324): n is a, c, g, or t
  modified_base (458)..(458): a, c, t, g, unknown or other
  misc_feature (458)..(458): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactggtccgccaagctccagggaagggctggtgtgggtctcacgtattaatagtgatgggagtagcacaagctacgcggactcgtgaagggccgattcaccatctccagagacaacgccaaagacacgctgtaatctgcaaatgaacagtctgagagccgaggacacggctgtgtattactgtgcaagncggtgcggagttcggggatgcatactactacgtacggtatggacttgtgggccgaacgggaccacggtccaccgtctctcagcctaccacgaacggcccagtccgtccttccccctggccgccctcgctcccgngcgcacctcgtcggggcacgcgccggaccgcgggctgccgtggtaccgaaggtacctacgttacctatactcgtcgtcg

SEQ ID NO: 152151 - DNA, 647 bp, Homo sapiens
  misc_feature: GYAE6OF01CBTZ7.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtggtctcacgtattaatagtgatgggatagcacaagctacgcggactccgtgaaggccattccaccatctccagagacaacgccaaagaacacgctgtatcctgcaaatgaacagtctgagacgccgaggaccacggtctggttagtatttaccgtgtagctaaaggacggtcccgggtggccggggtaaggtttccgggggatttggactattaaccgtacctacgtacgggttatcgggtacgtcgtcggggaccgaacgggaccgtacggtccaccgttcctccgtcgacgtccttaccgaacccgaacggtcccacgttccggttcccgttcccccgtcggcccgtcccgtcgccgtaccgaggtacgcctaccgtcggtcggggacctaccggacgcccggcccgttcgggccgtcggtccgtcgggtaccgaacggttacccttaccgttaccctattactccgtgttaccg

SEQ ID NO: 152152 - DNA, 310 bp, Homo sapiens
  misc_feature: GYAE6OF01ASFPH.44.38.D05.1.454.CMB.1.raw
  modified_base (261)..(261): a, c, t, g, unknown or other
  misc_feature (261)..(261): n is a, c, g, or t
  modified_base (263)..(264): a, c, t, g, unknown or other
  misc_feature (263)..(264): n is a, c, g, or t
  modified_base (266)..(310): a, c, t, g, unknown or other
  misc_feature (266)..(310): n is a, c, g, or t
tcagacagtatatacacgaccggtgctcgattttagtatctgatagttggggtttgggggagttgcatactactactacggtatggacgtctggggccaagggaccacggtccaccgtctcctcagcttccaccaagggcccatcggtcttccccctggccgccctgcctccaggagcacctctgggggcacacgcggccctgggctgcctggtcaaggctacttcctgatcgcgtctgagcgggctggcaggcgcatagngnnannnnnnnnnnnnnnnnnnnnnnnnnnnnnnnnnnnnnnnnnnnnn

SEQ ID NO: 152153 - DNA, 266 bp, Homo sapiens
  misc_feature: GYAE6OF01BIMZM.44.38.D05.1.454.CMB.1.raw
  modified_base (257)..(266): a, c, t, g, unknown or other
  misc_feature (257)..(266): n is a, c, g, or t
tcagacagtatatacacgaccggtgctcgatttagtatctgatagttgggggtttggggagttgcatactactactacggtatggacgtctggggccaagggaccacggtcaccgtctcctcagcttccaccaaggcccatcggtcttcccctggcgccctgctccaggagcacctctgggggcacagcggccctgggctgcctggtcaaggactacttcctatatactgtctgagcgggctggcaaggcgcatagnnnnnnnnnn

SEQ ID NO: 152154 - DNA, 205 bp, Homo sapiens
  misc_feature: GYAE6OF01C4V2W.44.38.D05.1.454.CMB.1.raw
  modified_base (166)..(205): a, c, t, g, unknown or other
  misc_feature (166)..(205): n is a, c, g, or t
tcagacagtatatacacgaccggtgctcgatttagtatctgatagttgggtttgggggaggtgtgtcacgtaagtatttgggctctgggacacagcggccctgggctgcctggcaaggactacttccgtatatactgtactgaggcgggctggcaaggcgcatagnnnnnnnnnnnnnnnnnnnnnnnnnnnnnnnnnnnnnnnn

SEQ ID NO: 152155 - DNA, 770 bp, Homo sapiens
  misc_feature: GYAE6OF01C2G4E.44.38.D05.1.454.CMB.1.raw
  modified_base (762)..(762): a, c, t, g, unknown or other
  misc_feature (762)..(762): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
  modified_base (769)..(769): a, c, t, g, unknown or other
  misc_feature (769)..(769): n is a, c, g, or t
tcagacagtatatacacgaccggtgctcgatttagtatctgatagtggagtccgggggaggcttagttcagcctggggggtcccttagactctcctgtgcagcctctggattcactttcagtaacgcctggatgacctgggtccgccaggctccgaggggaaggggctggaggtgggttggccgtattagaaccaaagctggacggtgggacagcagactacgctgcacccgtgaaaggcagacttcaccatcacaagagatgattacaaaagatacggtgtctctgcagatgaacagcctagaaccaccgaggacacacgtccgtacttattaccgtgtcgtgggtattgggtttacaggtttcgggggaccaacggggtaaaccccgttgggtccgaacccggttccttcccgtacgaccgtacccgtaccccgaacggaaccgggtccccctaacggttccccggttcccgtttcccccccgtcgggtccccgtcccccgttcgggaccccttcccggaagggacccggtaccctaccccgggttacccggaacggtaccggcccaaacccgggtacggacccggggtacccccgttcgggggccctccggggttcccgttaccggggtaccgtaaaaccggggtaccctttaccctttacccgttaagttaccgttaaccgttcggttaccggttacgggaccgggtcccggggtcggttccggggaacggtaaacgggcccggtaaccttaaggacncgngngng

SEQ ID NO: 152156 - DNA, 260 bp, Homo sapiens
  misc_feature: GYAE6OF01C913R.44.38.D05.1.454.CMB.1.raw
  modified_base (257)..(260): a, c, t, g, unknown or other
  misc_feature (257)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnn

SEQ ID NO: 152157 - DNA, 310 bp, Homo sapiens
  misc_feature: GYAE6OF01D4KF2.44.38.D05.1.454.CMB.1.raw
  modified_base (300)..(300): a, c, t, g, unknown or other
  misc_feature (300)..(300): n is a, c, g, or t
  modified_base (306)..(310): a, c, t, g, unknown or other
  misc_feature (306)..(310): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaaggcccatcggtcttccccctggcgccctgctccaggagcacctcgtggggcacagcggccctgggctgcctggtcaaggctactccacgtctactgctgagcggctggcaaggcncatagnnnnn

SEQ ID NO: 152158 - DNA, 315 bp, Homo sapiens
  misc_feature: GYAE6OF01CQHR4.44.38.D05.1.454.CMB.1.raw
  modified_base (309)..(315): a, c, t, g, unknown or other
  misc_feature (309)..(315): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaaggcgcatagnnnnnnn

SEQ ID NO: 152159 - DNA, 159 bp, Homo sapiens
  misc_feature: GYAE6OF01A2KKC.44.38.D05.1.454.CMB.1.raw
  modified_base (159)..(159): a, c, t, g, unknown or other
  misc_feature (159)..(159): n is a, c, g, or t
tcagacagtatatacacgaccggtgctcgatttagtatctgatagttgggtttggggaggtgtgtcacaagatttgggctctgggcacagcggccctgggctgcctggtcaaggactacttcctatatactgtctgagcgggctggcaaggcgcatagn

SEQ ID NO: 152160 - DNA, 581 bp, Homo sapiens
  misc_feature: GYAE6OF01E069U.44.38.D05.1.454.CMB.1.raw
  modified_base (145)..(145): a, c, t, g, unknown or other
  misc_feature (145)..(145): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (353)..(353): a, c, t, g, unknown or other
  misc_feature (353)..(353): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagacagtatatacacgaccggtgctcgatttagtatctgatagtggagtccgggggaggcttagttcagcctggggggtccctgagactctcctgtgcagcctctggattcaccttcaggacctatgccatgcactgggtccncaggctccaggcaaggggctggagtgggtgcaattatatcagaagntggaaattgaagaacactacgganactccgagaagggccattcaccgtctccagagacaattccaggaacacactgcatctgacaaatgtacaacctcaacaagtgagacacggctgtctattattgtcgcgacgacgtccccctgaacgaccggtccccgntttcgaactacgtcggggaccagggaaccctggtccaccgtctcctcacgcctccaccgaagggcccctagtccggtccttccccgtggcccgccgtgcctccgaggcnccncctcgagacgccacgacgccggccctgggcctacggccctgggtaccaagggtacccttaccgttaccctaatacttaccgtgtcctaggacggtccgggctgggaccgtaacggg

SEQ ID NO: 152161 - DNA, 259 bp, Homo sapiens; identical to SEQ ID NO: 152124
  misc_feature: GYAE6OF01CRD49.44.38.D05.1.454.CMB.1.raw
  modified_base (257)..(259): a, c, t, g, unknown or other
  misc_feature (257)..(259): n is a, c, g, or t

SEQ ID NO: 152162 - DNA, 257 bp, Homo sapiens
  misc_feature: GYAE6OF01EOLK0.44.38.D05.1.454.CMB.1.raw
  modified_base (256)..(257): a, c, t, g, unknown or other
  misc_feature (256)..(257): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaaggcgcatagnn

SEQ ID NO: 152163 - DNA, 263 bp, Homo sapiens; identical to SEQ ID NO: 152128
  misc_feature: GYAE6OF01EGWJJ.44.38.D05.1.454.CMB.1.raw
  modified_base (257)..(263): a, c, t, g, unknown or other
  misc_feature (257)..(263): n is a, c, g, or t

SEQ ID NO: 152164 - DNA, 260 bp, Homo sapiens
  misc_feature: GYAE6OF01B7U4J.44.38.D05.1.454.CMB.1.raw
  modified_base (258)..(260): a, c, t, g, unknown or other
  misc_feature (258)..(260): n is a, c, g, or t
tcagacagtatatacacgaccggtgctcgatttagtatctgatagttggggtttggggagttgcatactactactacggtatggacgtctgggaccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnn

SEQ ID NO: 152165 - DNA, 674 bp, Homo sapiens
  misc_feature: GYAE6OF01CT9F3.44.38.D05.1.454.CMB.1.raw
  modified_base (205)..(205): a, c, t, g, unknown or other
  misc_feature (205)..(205): n is a, c, g, or t
  modified_base (357)..(357): a, c, t, g, unknown or other
  misc_feature (357)..(357): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccncaagctccgaggggagggctggtgtgggtctcgacgtattaatagtgagtgggatagcacgaagctacggcggactccggtagaacgggccattcacctatcctaccagacgacaacgccaaagaccacgctagtatctgactaaatgaacngtctaggagacgccgaaggcacgggtctggtagttacttacgtggtagacgtaaggcggtaccgggtggaccggggttaagggtttcgggggaagtttcggacgtaacgttaaccgtaccgttaacggtacgggttagtcgggtacggttcggtcggggaccgtaacgggtaccgtacggtaccgtacccgtcgtccgtacgtacgtacccgttccgaaccgtacgggtccctacggttcccggttcccgttccccgtcgggtccgtcccgttcgcccgtaccggacggtaccgaccgtacccgtcgggtcgggacc

SEQ ID NO: 152166 - DNA, 579 bp, Homo sapiens
  misc_feature: GYAE6OF01EIENP.44.38.D05.1.454.CMB.1.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccaggggaaggggctggtgtgggtctcacgtattaatagtgatgggagtagcacaagctacgcggactccgngaaggccgattcacatctccaganacaacgccaaagaacacgctgtatctgacaaatgaacagtcngagagcgaggacacggntgtgtattcngtgacaagcgcggtgcgggtaggtcgggtagttgctatactactaacgtacggtagtggacgtcggtgggaccgaagggaccgacggtcaccgtctcccgtcacgtcctaccgaccgaacggcccctacgtcccggtcccttcccccggtcggcccgtccctcgtcctcccgacggacgaccgcccgtcggtcggggacccg

SEQ ID NO: 152167 - DNA, 314 bp, Homo sapiens
  misc_feature: GYAE6OF01EZ4KF.44.38.D05.1.454.CMB.1.raw
  modified_base (309)..(314): a, c, t, g, unknown or other
  misc_feature (309)..(314): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnnnn

SEQ ID NO: 152168 - DNA, 261 bp, Homo sapiens
  misc_feature: GYAE6OF01B6TFO.44.38.D05.1.454.CMB.1.raw
  modified_base (258)..(261): a, c, t, g, unknown or other
  misc_feature (258)..(261): n is a, c, g, or t
tcagacagtatatacacgaccggtgctcgatttagtatctgatagttggggtttggggagttgcatactactactacggtatggacgtctgggaccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnn

SEQ ID NO: 152169 - DNA, 570 bp, Homo sapiens
  misc_feature: GYAE6OF01D8XHM.44.38.D05.1.454.CMB.1.raw
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatcnccagagacaacgccaaagacacgctgtatctgcaaaatgaacagtctgagagccgaggacacggctgtgtattactgtgcaagngccggtgcggagttcggggattgcatactactactacggtatggacgtcgtggggaccgaacgggaccgacggtcaccgtctccctcacgcttcccaccgaacgggcccacgtccggtcccttccccgtcggccgtcccgtcgcctccgaggacgcctaccgtcgtcggggccacgacgccggcccgtcgggctcggccgtcggtaccgaaggaccttacttcccgtcgactccgtcgtccgg

SEQ ID NO: 152170 - DNA, 192 bp, Homo sapiens
  misc_feature: GYAE6OF01D8YM6.44.38.D05.1.454.CMB.1.raw
  modified_base (191)..(192): a, c, t, g, unknown or other
  misc_feature (191)..(192): n is a, c, g, or t
tcagacagtatatacacgaccggtgctcgatttagtatctgatagttgggtgtgggatagtagtagtgatcatcgggtgttcggcggagggaccaagctgaccgtcctaggtcagcccaaggctgccccctcggtcactctgttcccacctcctctatatactgtctgagcgggctggcaaggcgcatagnn

SEQ ID NO: 152171 - DNA, 261 bp, Homo sapiens
  misc_feature: GYAE6OF01DBMKS.44.38.D05.1.454.CMB.1.raw
  modified_base (255)..(261): a, c, t, g, unknown or other
  misc_feature (255)..(261): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactactcctatatactgtctgagcgggctggcaaggcgcatagnnnnnnn

SEQ ID NO: 152172 - DNA, 258 bp, Homo sapiens; identical to SEQ ID NO: 152085
  misc_feature: GYAE6OF01EN55K.44.38.D05.1.454.CMB.1.raw
  modified_base (257)..(258): a, c, t, g, unknown or other
  misc_feature (257)..(258): n is a, c, g, or t

SEQ ID NO: 152173 - DNA, 272 bp, Homo sapiens
  misc_feature: GYAE6OF01ARPXI.44.38.D05.1.454.CMB.1.raw
  modified_base (244)..(244): a, c, t, g, unknown or other
  misc_feature (244)..(244): n is a, c, g, or t
  modified_base (260)..(272): a, c, t, g, unknown or other
  misc_feature (260)..(272): n is a, c, g, or t
tcagacagtatatacacgaccggtgctcgatttagtatctgatagttgggtttggggaggttgcatactactactacggtatggacgtctggggccaagggaccacggtcaccgtctcctcagcttccaccaagggcccatcggtcttccccctggccgccctgctccaggagcacctcgtgggggcacagcggccctgggctgcctggtcaaggactacttcctatatactgtctgagcgggntggcaaggcgcatagnnnnnnnnnnnnn

SEQ ID NO: 152174 - DNA, 279 bp, Homo sapiens
  misc_feature: GYAE6OF01EN33G.44.38.D05.1.454.CMB.1.raw
  modified_base (265)..(279): a, c, t, g, unknown or other
  misc_feature (265)..(279): n is a, c, g, or t
tcagacagtatatacacgaccggtgctcgatttagtatctgatagttgggggtttggggaagttgcatactactactacggtatggacgtctggggccaagggaccacggtcaccgtctcctcagcttccaccaagggtcccatcggtcttccccctggcgccctgctccaggagcacctcgtgggggcacagcggccctgggctgcctggtcaaggactacttccgacgtctactgactgagcgggctggcaaggcgtcatagnnnnnnnnnnnnnnn

SEQ ID NO: 152175 - DNA, 574 bp, Homo sapiens
  misc_feature: GYAE6OF01CJN4H.44.38.D05.1.454.CMB.1.raw
  modified_base (204)..(204): a, c, t, g, unknown or other
  misc_feature (204)..(204): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccnccaagctccgagggaaggggctgggtgtgggtctcacgttattaatagtgagtgggagtagcacaagctacgcggactccgngaaggccatcacatcncagagacaacgccaagaacncgctgtatcngacaaatgaacngtcagagagcgagacacggctgtntatacngtgacaaggcgcggtggcgggtaggtcgggtagttgctatactactacgtacggtagtggacgtcgtcgggacgaacgggaccgacggtccaccgtcctccgtcacgtcctaccgaccgacggccctacgtccggtcccgttccccgtcggcccgtcccgtcgccctccgacggacacccgaccgtcggtcggggacccg

SEQ ID NO: 152176 - DNA, 263 bp, Homo sapiens; identical to SEQ ID NO: 152128
  misc_feature: GYAE6OF01AC747.44.38.D05.1.454.CMB.1.raw
  modified_base (257)..(263): a, c, t, g, unknown or other
  misc_feature (257)..(263): n is a, c, g, or t

SEQ ID NO: 152177 - DNA, 260 bp, Homo sapiens; identical to SEQ ID NO: 152156
  misc_feature: GYAE6OF01DNCZ0.44.38.D05.1.454.CMB.1.raw
  modified_base (257)..(260): a, c, t, g, unknown or other
  misc_feature (257)..(260): n is a, c, g, or t

SEQ ID NO: 152178 - DNA, 704 bp, Homo sapiens
  misc_feature: GYAE6OF01DUM34.44.38.D05.1.454.CMB.1.raw
  modified_base (363)..(363): a, c, t, g, unknown or other
  misc_feature (363)..(363): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccgccaagctccgaggggagggctggtggtgggtctcgacgttattaataggtgagtgggagtagcaacaagctacgcggtactccggtggaacgggcctattccaccatcctccgagacgacaacgccaaagaaccacgctgtatctaggacaaaatcgaaacgtgtactaggaacggagacccggaggtaccaccggtcttaggtacgtaatttacgngtagacgaaggcgcgggtggacgggtaggttcgggatttgctaacttaccgtacttacgttacgggtctagggtaccgtggtacggggacccgaacgggacccgtaccggtccgacccgttcctcccgtacgtacggtaccttacccgaaccgaaccggtacccgtaccgttcccgttcccgttcccccggtccggtcccgtcccgtcgtcccgtaccgacggaccgccgtacccgtccggtcggggaccacggaccggtccggcccgtcgggtccgtcggacccggtcgggtacctaacgggtaccttaccgttaccgttaataccgttcgttcgtacgg

SEQ ID NO: 152179 - DNA, 661 bp, Homo sapiens
  misc_feature: GYAE6OF01CF5WH.44.38.D05.1.454.CMB.1.raw
tcagacagtatatacacgaccggtgctcgatttagtatctgatagttgggtttgggggaagaggaagactgacggtcctcccaggagttcaggtgctgggcaccttgggcacgggggaggcttagttcagccgtggggggtccctgagactctcctgtgcagcctctggattcaccttcagtagctactggatgcacgtcgggtccgccaagcctccgaggggaggggtctggtgtgggtctcacgtattaataggtgagtggggagtagcaacgaagctacggcggtactccggtggaacgggcctattccaccatcctaccagaacgacaacgccaaaagaaccacgtctagtactctgactaaatcgaaactaggtctagagacggaccgaggacgtacggctagttagtaattcgtggtcgaacgaaggcggccgggtgggacggggtagggttcgggtagttgactagtactactacgtacggtagtggtacggtcggtacgggaccgaacgggtacccgacggtaccgtaccgtccgtcctacgacgtcctacccgaacccgtacggccccgtacgtcccggttaccccgttccccgtcggcccgtccccgtcgccctaccggacggaccgaccgtacccgtcgggtcgggcccg

SEQ ID NO: 152180 - DNA, 722 bp, Homo sapiens
  misc_feature: GYAE6OF01EIP7U.44.38.D05.1.454.CMB.1.raw
  modified_base (142)..(142): a, c, t, g, unknown or other
  misc_feature (142)..(142): n is a, c, g, or t
  modified_base (274)..(274): a, c, t, g, unknown or other
  misc_feature (274)..(274): n is a, c, g, or t
tcagacagtatatacacgaccggtgctcgatttagtatctgatagtggagtccggggagcttagttcagcctggggtcctgagactctcctgtgcagcctctggattcaccttcagtagctactggatgctacgtgggtccnccaagcctaccgagggagggctggtgtcggtctcacgtattaagtagtgatgggatagctacgaagctacgcgtactccgtagaacgggcctagttccacctatcctcgagacgtaccaacgcctaaagacncgcttagtatcagactaagttcgaacaggtctaggacgacggacccggaaggtaccacggtcttcggttacgtacgttacgtggtacgaccgaaggtcggtacccggtggtaccgggtgttacggggtatcgactaacgttacgtacgtacgttacggagttaggaaccgttccgtacggggaaccctaacggggtaccctaccgggttaccctacccggttcctacccgttacgaccggttacctttaaccccgaaccggtaacgggtacccctacgttacggttccccttcccgtacggccgttacccgtcggtacctccggaaggtcctccgttaaccgtcgtcggggactacggaccgcccggtcgtccgggacctggtacccggttacggtaccgtaacggttcccttacgtttaccgtaatacgtttccggcgtttaccggg

SEQ ID NO: 152181 - DNA, 262 bp, Homo sapiens
  misc_feature: GYAE6OF01A4SUH.44.38.D05.1.454.CMB.1.raw
  modified_base (257)..(262): a, c, t, g, unknown or other
  misc_feature (257)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 152182 - DNA, 352 bp, Homo sapiens
  misc_feature: GYAE6OF01EFWXS.44.38.D05.1.454.CMB.1.raw
  modified_base (178)..(178): a, c, t, g, unknown or other
  misc_feature (178)..(178): n is a, c, g, or t
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (274)..(280): a, c, t, g, unknown or other
  misc_feature (274)..(280): n is a, c, g, or t
  modified_base (282)..(282): a, c, t, g, unknown or other
  misc_feature (282)..(282): n is a, c, g, or t
  modified_base (284)..(286): a, c, t, g, unknown or other
  misc_feature (284)..(286): n is a, c, g, or t
  modified_base (288)..(288): a, c, t, g, unknown or other
  misc_feature (288)..(288): n is a, c, g, or t
  modified_base (290)..(352): a, c, t, g, unknown or other
  misc_feature (290)..(352): n is a, c, g, or t
tcagacagtatatacacgaccggtgctcgatttagtatctgatagttgggtttggggagggttgcatactactactacggtatggacggtctggggcccaagggaccacggtccaccggtctcctcagcttccaccaaggcccatccgtcttccccctggcgccctgctccagggacncacctcgtcgggggcacagcggccctgggcctgcctggtcaaggcctacttcctatatactgtctgagcgggctggacaacggcgcatagnngntnnnnnnnancnnnancnnnnnnnnnnnnnnnnnnnnnnnnnnnnnnnnnnnnnnnnnnnnnnnnnnnnnnnnnnnnnnn

SEQ ID NO: 152183 - DNA, 263 bp, Homo sapiens
  misc_feature: GYAE6OF01ASIGP.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaggcgcatagnnnnnnnn

SEQ ID NO: 152184 - DNA, 312 bp, Homo sapiens
  misc_feature: GYAE6OF01B0RMA.44.38.D05.1.454.CMB.1.raw
  modified_base (308)..(312): a, c, t, g, unknown or other
  misc_feature (308)..(312): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcggctggcaaggcgcatagnnnnn

SEQ ID NO: 152185 - DNA, 666 bp, Homo sapiens
  misc_feature: GYAE6OF01BCFQD.44.38.D05.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (597)..(597): a, c, t, g, unknown or other
  misc_feature (597)..(597): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgttattaatagtgatgggagtagcacaagctacgcggactccgtgaacggcctattcaccatcncaganacacgcaagaacncgctgtatctgacaaatgaacagtctagagacgccggaggaccgacggtcttggtagttaactttacgtggtacgactaaaacgggcggtcccgggttagggacgggggtaggtttacggggggtaattcggactaacgttaacctaacgttaaccgtacgggttaatcggggaccgttcggtacgggggacccgaacgggacccgtaccgggtcctaacccgttctcccgtcgacgtcccgttacccgaacccggtaacgggtccctacgttcccggttccccttccccgtcggcccgtccccgtgccctaccgaggtacgccgtaccgtcggngggccacgcgggccggtccgtcggccttcgccgtcggacaacggtaccttactactatactcgtgtacg

SEQ ID NO: 152186 - DNA, 258 bp, Homo sapiens
  misc_feature: GYAE6OF01C9LWB.44.38.D05.1.454.CMB.1.raw
  modified_base (256)..(258): a, c, t, g, unknown or other
  misc_feature (256)..(258): n is a, c, g, or t
tcagacagtatatacacgaccggtgctcgatttagtatctgatagttgggtttgggacagacttcactctcagcatcagcggactggagcctgaggattctgcagtttattactgtcagcagtatggttggtcacctctgacgttcggccaagggaccaaggtggaaatcaaaacgaactgtgactgcaccatctgtctcatcttcccgcatctgatatatactgtctggacgcgggctggcaaaggcgcaatagnnn

SEQ ID NO: 152187 - DNA, 275 bp, Homo sapiens
  misc_feature: GYAE6OF01BJIEZ.44.38.D05.1.454.CMB.1.raw
  modified_base (138)..(138): a, c, t, g, unknown or other
  misc_feature (138)..(138): n is a, c, g, or t
  modified_base (227)..(238): a, c, t, g, unknown or other
  misc_feature (227)..(238): n is a, c, g, or t
  modified_base (240)..(275): a, c, t, g, unknown or other
  misc_feature (240)..(275): n is a, c, g, or t
tcagacagtatatacacgaccggtgctcgatttagtatctgataggttgggtttggggccgaagggaccacggtcaccgtctcctcgagcttccaccaagggcccatcggtcttccccctggcgccctcgctccaggngcacctctgggggcacagcggccctgggctgcctggtcaaggactacttcctatactactgtctgagtcgggctggcaaggcgcatagnnnnnnnnnnnnannnnnnnnnnnnnnnnnnnnnnnnnnnnnnnnnnnn

SEQ ID NO: 152188 - DNA, 769 bp, Homo sapiens
  misc_feature: GYAE6OF01DQY2O.44.38.D05.1.454.CMB.1.raw
  modified_base (207)..(207): a, c, t, g, unknown or other
  misc_feature (207)..(207): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagccgtggggggtccctgagactctcctgtgcagcctctggattcaccttcagtagctactggatgcacgtgggtccnccaagctccgaggggagggctgggtgtgggtctcacgttattaagtagtgagtgggagtagcaacaagctacggcgactcgnggaacggccatcacntcncagacacaacgccaagacncgctgtatcagaacaaagtcgaactgtctaggaacgacggacccggaaggaccacgggtctttaggttacgttaaactttacgtggtacggaacgtaaaggggtccggggtccggggtaggggtaccgggggttaacggggtttacggggggtaagtttacggaaccgttaaacgttaaccgtttaacgttaacggttaacgggttacgtacgggtaccggttcggggtaccggggaaccggtaaaccggggacccgtaccgggttacccgtacccggttccgttaccccgtaccgaccggttccccttaccccggaaacccggtaccgggaccccttaccggttcccggttcccccgtttccccggcgggtccccgttccccgtcggacccgtcccggaacgggtacccgacccgtacccggttcggggtcggggaaccccg

SEQ ID NO: 152189 - DNA, 259 bp, Homo sapiens
  misc_feature: GYAE6OF01EQFPN.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnn

SEQ ID NO: 152190 - DNA, 734 bp, Homo sapiens
  misc_feature: GYAE6OF01BSUAY.44.38.D05.1.454.CMB.1.raw
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcacgtgggtccgccaagctccgaggggaaggggctgggtgtgggtctcacgttattaatagtgagtgggagtagcacaagctacggcggactccggtagaacgggccgtattccgacctatcctccagagaccaacgccaaagaacacgctgtaactctgacaaagtcgaaacgagtactgaagacgacggtaaggaccacgggcttggtagttaactttacgtggttacgacgtaagggacggtaccgggttgggaccggggtagggtttacgggggtacggtttggacgtaagttaaccgttaacgttaacgttaacggttaggtacgggtacccgttacgggtacgggggtaaccgaacggggtacccgtaaccgggtacctacccggtccttacccgtacgacgtacccttacccgacccggtaaccgggcccctaacggttccccggttacccgttcccccgtgggtaccccgttccccgtcggtcccgtaccggtaacggtaccgacccgtacccgtcgggtcggggtaacccg

SEQ ID NO: 152191 - DNA, 623 bp, Homo sapiens
  misc_feature: GYAE6OF01CZTVW.44.38.D05.1.454.CMB.1.raw
  modified_base (221)..(221): a, c, t, g, unknown or other
  misc_feature (221)..(221): n is a, c, g, or t
  modified_base (484)..(484): a, c, t, g, unknown or other
  misc_feature (484)..(484): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgagtgggatagcacaagctacgcgactcgngaggccatcaccatctcagacgacaacgacaagacacgctgtatctgacaaatgaacagtctagaagcgaccgaggacacggctagtgtaattacgtgtcgacgaaaggcggccgggtaggacgggtaggttcggggattcgactaagttactacgtacgtacggtagtcggacgtcggtacgggaccgaagggacctacggtccaccgtctcctacgacgtccttaccgaccgtacggccctacgttccgtcccttccccgnggcccgtcccgtgccgtccgaacggcctaccgaccgtcggtcggggaccacggaccggcccggcccgtgggcctcgggacccgttgggtaccaacgggtacccttacccgttacgaaccgttcctaccggtgtaccggg

SEQ ID NO: 152192 - DNA, 266 bp, Homo sapiens
  misc_feature: GYAE6OF01ED3YE.44.38.D05.1.454.CMB.1.raw
  modified_base (257)..(266): a, c, t, g, unknown or other
  misc_feature (257)..(266): n is a, c, g, or t
tcagacagtatatacacgaccggtgctcgatttagtatctgatagttgggtttggggagttgcatactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatagnnnnnnnnnn

SEQ ID NO: 152193 - DNA, 580 bp, Homo sapiens
  misc_feature: GYAE6OF01AIVHZ.44.38.D05.1.454.CMB.1.raw
  modified_base (510)..(510): a, c, t, g, unknown or other
  misc_feature (510)..(510): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcgactccgtgaagggccattcaccatctccagagacaacgccaaagaacacgctgtatctgcaaatgaacagtctgagagccgaggacacggctgtgtattactgtgcaagagccggtgcgggtaggttcggggagttgacatactacgtacgtacggtatggacgtcgtggggaccgaagggacccacggtccaccgtctccctcgacgccttaccgacccgaacgggccccacgtccggttcccgttcccccgtggcccgtcccgtcgcctccgacggacgcaccgtcgtggggcncgagcccggccgtcgggtctcggccgtggtccgaaacggtaccttacttcccgtattacttcgtgttcgg

SEQ ID NO: 152194 - DNA, 290 bp, Homo sapiens
  misc_feature: GYAE6OF01CLJQP.44.38.D05.1.454.CMB.1.raw
  modified_base (285)..(290): a, c, t, g, unknown or other
  misc_feature (285)..(290): n is a, c, g, or t
tcagacagtatatacacgaccggtgctcgatttagtatctgatagttgggtttgggggtcccatcaaggttcagcggcagtggatctgggacagaattcgctctcaccatcagcagcctgcagcctgatgattttgcaacttattactgccaacagtataagagttattctcagagttttggccaggggaccaagctggagatcaaacgactgtggctgcaccatctgtcttcatcttcccgcatctgatatatactgtctgagcgggctggcaaggcgcatagnnnnnn

SEQ ID NO: 152195 - DNA, 566 bp, Homo sapiens
  misc_feature: GYAE6OF01DHNJT.44.38.D05.1.454.CMB.1.raw
  modified_base (150)..(150): a, c, t, g, unknown or other
  misc_feature (150)..(150): n is a, c, g, or t
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
  modified_base (562)..(562): a, c, t, g, unknown or other
  misc_feature (562)..(562): n is a, c, g, or t
tcagacagtatatacacgaccggtgctcgatttagtatctgatagtggaggtccgggggagcttagttcagccgtggggggtccctgagactctcctgtgcagcctctggattcacctttcagtagctacgtggatgcacgtgggtcccnccaagctaccgagggaggctggtgtggtactcacgtattaagngtgagtgggatagcacagctacgcgactcgagaaggccattcacntcncgagacacaacgccaagaacncgctntatctgacaaagtnaacgngtcagagacgtccggagacgcgctgtatatcgtgacagaaggngccggtggcgggtaggttcgggatgactataccgtacgtacgtaaggtctggaacgttcgacggggactaacgggactaccgggtaccacgtcgtactcacggctaccgacgtacggcctcgtcgtcccttcccggtcccgccgtgcctcgacggcctacncccgttcggcgggccnccgacggtcccgcgttcggcctcgcgtcgaacgtacgtcctactaccgtatacgtngtcg

SEQ ID NO: 152196 - DNA, 259 bp, Homo sapiens; identical to SEQ ID NO: 152102
  misc_feature: GYAE6OF01EMMRK.44.38.D05.1.454.CMB.1.raw
  modified_base (257)..(259): a, c, t, g, unknown or other
  misc_feature (257)..(259): n is a, c, g, or t

SEQ ID NO: 152197 - DNA, 663 bp, Homo sapiens
  misc_feature: GYAE6OF01AP7TE.44.38.D05.1.454.CMB.1.raw
  modified_base (261)..(261): a, c, t, g, unknown or other
  misc_feature (261)..(261): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccgagggagggctggtgtggtctcacgtattaatagtgatgggatagcacaagctacgcggactccgtggaacgggccattcaccatctcagacacaacgccaagaacncgctgtatctgacaaagtgaacagtctaggacgacggccgaaggccacgggtctgtacgttattcgtgtacgacgaaggcggccgggtggcgggtacggttcggggattcgactaagttacgtactacggtacggtagtcgggaccgtcggtacggggaccgtaacgggacccgtacggtaccgaccggttccttcccgtacgacgtcccgttacccgaccggaacgggccctacggttcccggttcccttccccggcggtcccgtccgtcgcccgtaccgaggtccgaccgtaccgttcgggngggacccnggtccggcccgggtccgtcggggtctccgggccgttacgggaccgtaacggtcccttaaccgttcctaagtttacgtcgttcggtaccgg

SEQ ID NO: 152198 - DNA, 700 bp, Homo sapiens
  misc_feature: GYAE6OF01BP08D.44.38.D05.1.454.CMB.1.raw
  modified_base (143)..(143): a, c, t, g, unknown or other
  misc_feature (143)..(143): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagacagtatatacacgaccggtgctcgatttagtatctgatagtggagtccggggagcttagttcagcctgggggtccctgagactctcctgtgcagcctctggattcacctttcagtagctactggatgcactgggtccnccaagctccgagggagggctggtgtggtctcacgtattaatagtgatgggatagcacaagctacgcggactcgtagaagggccattcaccagtctaccagagaccaacggccaaagaaccacgtctagtatctagacaaaagtgaaacagttcngagacgccgaggacnggctgctattcngtgcgtaagcgtcggtgcgggtagtttcggggattcgctaagttaacctacgttaaccgttacgggtagttcgggaacgtttccgtacgggggaacccaaggggtaccccgtacggtaccgtaacccggttcttcccggtacgaacgtccgtttaaccccgaaccgaaacgggtcccctaaccgtttcccggttacccctttcccccggtaggtcccccgtacccgttaccggcccttaccccggaaggggtacccacccgtccggttaccggtcggggcccaaccggtacggcccggtaccccgtggggccctacgggtcccgtacggaccgaaacggttccttaccgtttaccaagtacgttccgtggtacccg

SEQ ID NO: 152199 - DNA, 553 bp, Homo sapiens
  misc_feature: GYAE6OF01BZ162.44.38.D05.1.454.CMB.1.raw
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattaggaagtaaaagtgtgcactggtaccagcagaagccaggccaggcccctgtgctggtcatctattatgatagcgaccggccctcgagggactcccctggagcgtattcgtcgtggcctacccaactcgtagggaaccaccggacccacccgtgaccatccgagcgagggtcgaacggccggggatgggacggccgtatattacgtgtcgaggtggtgggataggtagtagtgatgagtcgggtgtcggacgggaggacagcgtgaccgtcgtaggtcagcccgaggcctccgcccctggtccactctccgtccccgtcccc

SEQ ID NO: 152200 - DNA, 192 bp, Homo sapiens
  misc_feature: GYAE6OF01A93O9.44.38.D05.1.454.CMB.1.raw
  modified_base (192)..(192): a, c, t, g, unknown or other
  misc_feature (192)..(192): n is a, c, g, or t
tcagacagtatatacacgaccggtgctcgatttagtatctgatagttgggtgtgggatagtagtagtgatcatcgggtgttcggcggagggaccaagctgaccgtcctaggtcagcccaaggctgccccctcggtcactctgttcccaccctcctctatatactgtctgagcgggctggcaaggcgcatagn

SEQ ID NO: 152201 - DNA, 593 bp, Homo sapiens
  misc_feature: GYAE6OF01A38KI.44.38.D05.1.454.CMB.1.raw
  modified_base (311)..(311): a, c, t, g, unknown or other
  misc_feature (311)..(311): n is a, c, g, or t
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtgggcccccaggtacggggggtccctggagacctctcctgtgcagcctctggattcaccttcgataatggaatatgcagtgggtccnccgaggcctccgaggcggaggggcgtgggaggtgggtggcgagggtcgtgtctatttcgagtggaaggtaaatcgtaagtcgtacggtgtagttccgttggacggtccgtattcacctatctcagagacaacgtacgacgaacactagtcgtacttactacaatacgaacgacgcctagacgtacctacgacggaccgtacggaccgttgttacgtttgtagtcgagtactacttcgttacgttaccgtaaacgttcgtactagttcgtcgtccggtacggg

SEQ ID NO: 152202 - DNA, 315 bp, Homo sapiens
  misc_feature: GYAE6OF01BSFEH.44.38.D05.1.454.CMB.1.raw
  modified_base (310)..(315): a, c, t, g, unknown or other
  misc_feature (310)..(315): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnn

SEQ ID NO: 152203 - DNA, 728 bp, Homo sapiens
  misc_feature: GYAE6OF01EO9B9.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcacctttcagtagctactggatgcacgtgggtccgcaagctccgagggaagggctggtgtggtctcacgttattaagtagtgagtgggatagcaacaagctaacggcggtactccggtagaacgggcctattccgaccatcctaccgagacgaccaacgccaaagaaccacgctagtatctagacaaagtgaaactagtcgtagaagacggccggaaggaccgacggtctgtagttattactgtacgacgaaggacgccgggtggacgggtaggttcgggggattgactaattaaccgtaacgtaccgtaggtagtacggacgttcggtacgggaccgaacgggaccgtaccggtccgtaccgtcttacccgtcgtacgtccttacccgaaccgtaaccgggtcccctaagttccccggttacccgtttcccccgtcgggtcccgtcccgtcgtacccttaccggacgggtaccgtacccgtaccggtcgggtaccgggggtaccaccgggaccgggtcccggtcccggtcgggtccgtacggtcccggttacgggtaaccggtaaacggtacccgtttacccgttaccgtttaattacgtttacgtcggttacgg

SEQ ID NO: 152204 - DNA, 521 bp, Homo sapiens
  misc_feature: GYAE6OF01BX8LV.44.38.D05.1.454.CMB.1.raw
  modified_base (269)..(271): a, c, t, g, unknown or other
  misc_feature (269)..(271): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (303)..(304): a, c, t, g, unknown or other
  misc_feature (303)..(304): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (345)..(346): a, c, t, g, unknown or other
  misc_feature (345)..(346): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagacagtatatacacgaccggtgctcgatttagtatctgatagttggggttttgggggagttgcactactactacgtacggtatggacgtctgggggccaagggaccacgggtccaccgtctcctcagcgttccaccaagggcccatcggtcttcccccgtggccgcccgtgctccaggagcacctctgggggcacacgcggccctgggcctgctggtcaggactacttctagtatactgtctgagcgggctggtcaggcgcatagnnnangtgtgctgncngnagacngacncctgctgnncncagctnagttanagngcctatgaagccgagngcgcgtgnngacgatagtactctcncacncancacacgcncgncgcncgtgtctagtactactactctactacgtacgtacgtacgtaacgttacgttacgtcgtacgtacgtacgtacgacgacgtacgacgtagtacgtaacgtacgtagtacgtcgcgtcgctactactattcttcgtctc

SEQ ID NO: 152205 - DNA, 272 bp, Homo sapiens
  misc_feature: GYAE6OF01B135I.44.38.D05.1.454.CMB.1.raw
  modified_base (265)..(272): a, c, t, g, unknown or other
  misc_feature (265)..(272): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttcccctggccgccctgctccaggagcacctcgtgggggcacagccggccctgggctgcctggtcaaggctacttccacgtctactgctggacggcgggctgggacaacggcgacagtagnnnnnnnn

SEQ ID NO: 152206 - DNA, 260 bp, Homo sapiens
  misc_feature: GYAE6OF01A7WCQ.44.38.D05.1.454.CMB.1.raw
  modified_base (257)..(260): a, c, t, g, unknown or other
  misc_feature (257)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccttggcgccctgctccaggagcacctctgggggcacagcggccctgggctgcctggtcaaggactacttccacgtctactgctgagcgggctggcaaggcgcatagnnnn

SEQ ID NO: 152207 - DNA, 673 bp, Homo sapiens
  misc_feature: GYAE6OF01D6OYQ.44.38.D05.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
tcagacagtatatacacgaccggtgctcgatttagtatctgatagtggagtccgggggaggcttagttcagcctggggggtccctgagactctcctgtgcagcctctggattcacctttcagtagctactggatgcacgtgggtccgccaagctcgagggagggctggtgtggtctcacgtattaatagtgagtgggagtagcagaagctacgcgactcgtgaacgggcctattcacatcncaganacaacgcaagaacncgctgtatctgactaaatgaacngtactggagcgaccgaaggacacggcttggtagtattacgtgtacgacgaaaggtacggccgggtgggacgggtagggtttcgggggattgactaagtaacgttacgtaacgttacgggtacgtcggaacggttcggtacgggggtaccgaaacggggtaccctaccggtccgtacccgttcctacccgtcgacgtcctacccgaaccgtacgggcccctagttccccggttacccttcccccgtagggcccgtcccgtcgcctaccggaggtacccgtccgaaccgttccgggcgggaccacggtccgggaccggtcccgtgggccgtcggtccggtcggaacgtaaccggttacccttacttacgttaactacgttagtcggtaccgg

SEQ ID NO: 152208 - DNA, 258 bp, Homo sapiens; identical to SEQ ID NO: 152085
  misc_feature: GYAE6OF01E1JDD.44.38.D05.1.454.CMB.1.raw
  modified_base (257)..(258): a, c, t, g, unknown or other
  misc_feature (257)..(258): n is a, c, g, or t

SEQ ID NO: 152209 - DNA, 284 bp, Homo sapiens
  misc_feature: GYAE6OF01CVVV7.44.38.D05.1.454.CMB.1.raw
  modified_base (264)..(284): a, c, t, g, unknown or other
  misc_feature (264)..(284): n is a, c, g, or t
tcagacagtatatacacgaccggtgctcgatttagtatctgatagttgggtttgggggagttgcatactactactacggtatggacgtctggggccaagggaccacggtcaccgtctcctcagcttccaccaagggcccatcggtcttcccctggcgccctgctccaggagcacctcgtgggggcacgagcggccctgggctgcctggtcaaggactacttcctatatactgtctggagcgggctggcgaaggcgacagtaggnnnnnnnnnnnnnnnnnnnnn

SEQ ID NO: 152210 - DNA, 884 bp, Homo sapiens
  misc_feature: GYAE6OF01DBW3Z.44.38.D05.1.454.CMB.1.raw
  modified_base (262)..(262): a, c, t, g, unknown or other
  misc_feature (262)..(262): n is a, c, g, or t
  modified_base (421)..(421): a, c, t, g, unknown or other
  misc_feature (421)..(421): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcacgccgttggggggtccctgagactctcctgtgcagcctctggtacttccaccttcagtagctacgtggatgcacgtcgggtccgccaagctaccgaggggaagggctggtgtgggtctcacgtattaatagngagtgggagtagcaacgaagccgtacggaccggtacctccggtagggaaaccggggtcctaatttaccaaccgtattccctccgaaggaacgaaccgaaccggaccaaaacgaacctaacggctttagtactctacgacaaacgtagaacgtagttacnggaacggacgacccgggaacggtaaccgacgggttactcggttaaggtttagtttaaccgtgggtaacggaaccgtaacggggtaccgggtaccgggggtttcggggtaacggggtttaccggggggtaacgtttacggacctttaacgttaaccgtttaaacccgttaccgggtttaacggtacggttacggggtaccggttaccggggtaaccgggggaaccccgtaaaccggggggtaaccctaccgggttaaccccgtaaccccggttcgttaccccgttacgaacccgtttaccccttaaccccggaacggtaacccgggtaccccggttacgttacccccgggttttccccggtccccccggtcgggtcccccttaccccggtccgtaccccgggttcccgaacgggttccccggacccgtttacccgggtcggggtcccgggggcccgaaaccggg

SEQ ID NO: 152211 - DNA, 263 bp, Homo sapiens
  misc_feature: GYAE6OF01C601V.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttcccctggcgccctgctccaggagcacctctgggggcacagcggccctgggctgcctggtcaagggactacttcctatatactgtctgagcgggctggcaaggcgcatagnnnnnnnn

SEQ ID NO: 152212 - DNA, 259 bp, Homo sapiens
  misc_feature: GYAE6OF01D2UYR.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttcctcgatcgcgtctgagcgggctggcaaggcgcatagnnnn

SEQ ID NO: 152213 - DNA, 317 bp, Homo sapiens
  misc_feature: GYAE6OF01AT907.44.38.D05.1.454.CMB.1.raw
  modified_base (308)..(317): a, c, t, g, unknown or other
  misc_feature (308)..(317): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcggctggcaaggcgcatagnnnnnnnnnn

SEQ ID NO: 152214 - DNA, 786 bp, Homo sapiens
  misc_feature: GYAE6OF01A4HDU.44.38.D05.1.454.CMB.1.raw
tcagacagtatatacacgaccggtgctcgatttagtatctgatagtggagtccgggggaggcttagttcagcctgggggggtccctgagactctcctgtgcagcctctggattcaccttcagtagctactggatgcactgggtccgccaagctccagggaaggggctggtgtgggtctcacgtattaatagtgatgggagtagcacaagctacgcgactccgtgaggccgattcaccatctccagacgacaacgccaagaaccacgctgtatctgcaaatgaacagtctagagacgccgaggacacggctgtgtattactgtgacaaggacggccgggtggccgggggtaggtttccggggggtagtttcggacctaagttaaccgtaaccgtaaccgttacgggtaacgttaggggaccgtttcgggcgggggtaacccgaacgggggaaccccgtaccggggttcccaaccccggttcccttccccgtaccgtaccggtccctttaccccgaacccggtaaccggggccccctacgttaccccgggttccccgtttacccccccggtcgggtccccgtcccccgttccggtcccttacccggaacgggtacccgtacccgtaccccggttcccggggtaccggggggtaccctacccggaccgggtccccgggtcccccgggttgggggtcccgtccgggttaccccggttcgggtaacccgtaaacggggtaccctttaacccgtttacccgtaagtttacccgttaccgttcggttacccgg

SEQ ID NO: 152215 - DNA, 723 bp, Homo sapiens
  misc_feature: GYAE6OF01B5ZTP.44.38.D05.1.454.CMB.1.raw
  modified_base (120)..(120): a, c, t, g, unknown or other
  misc_feature (120)..(120): n is a, c, g, or t
  modified_base (189)..(189): a, c, t, g, unknown or other
  misc_feature (189)..(189): n is a, c, g, or t
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (639)..(639): a, c, t, g, unknown or other
  misc_feature (639)..(639): n is a, c, g, or t
  modified_base (676)..(676): a, c, t, g, unknown or other
  misc_feature (676)..(676): n is a, c, g, or t
tcagacagtatatacacgaccggtgctcgatttagtatctgatagtggagtccgggggagcttagttcagccgtggggggtccctgagactctcctgtgcagcctctggattcacctttnagtagctatggatgcacgtgggtccacaagcctcgaaggggaagggctggtgtggtctcacgtattaanggtgagtgggagtacgcaacgaagcctacggccgtactccggagaacggcctatccacatctacgaagacgaacaacgtaccaaagtaacacgctagtactcgtagaactaaagcgaaaccgngttcgaggaacgacggtaccggaaggtaccagggtcttggttactaacgtttagnggtacgaagaacgggtacggcccgggtggtaccgggtttaagggttccgggggtatttaggaacttaaccggttaaacgttacgttaaacgggttaaccgtggaaacggggttcgtaccgggtcggggaaccgtaaacggggtaccctaacgggtccctaacggttcctacccgtagaaccctcgtaaccgaccgtaaggtaccccgtagttccccggttcccctacccgtgggccctaccggtccacgtacccggagtaccgccgttacgngggtccggactaccggacgtcccgggtagcgttacgngtacccgtagaccggaagttaccttacgtactattctaccgtcgtag

SEQ ID NO: 152216 - DNA, 258 bp, Homo sapiens
  misc_feature: GYAE6OF01DBUNC.44.38.D05.1.454.CMB.1.raw
  modified_base (252)..(252): a, c, t, g, unknown or other
  misc_feature (252)..(252): n is a, c, g, or t
  modified_base (257)..(258): a, c, t, g, unknown or other
  misc_feature (257)..(258): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctcgtgggggcacagcggccctgggctgcctggtcaaggactacttccacgtctactgctgagcgggctggcaaggcgnatagnn

SEQ ID NO: 152217 - DNA, 262 bp, Homo sapiens
  misc_feature: GYAE6OF01D35KG.44.38.D05.1.454.CMB.1.raw
  modified_base (257)..(262): a, c, t, g, unknown or other
  misc_feature (257)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctcgtgggggcacagcggccctgggctgcctggtcaaggctacttccacgtctactgctgagcgggctggcaaggcgcatagnnnnnn

SEQ ID NO: 152218 - DNA, 742 bp, Homo sapiens
  misc_feature: GYAE6OF01CQ1SR.44.38.D05.1.454.CMB.1.raw
  modified_base (146)..(146): a, c, t, g, unknown or other
  misc_feature (146)..(146): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccncaagctccgaggggaagggctgggtgtgggtctcacgttattaatagtgagtgggagtagcaacaagctacggcgactcggtagaacgggccattcacatcctaccagacaacaacgaccaaagaactacgctagtatctagacaaaatgaacctggtctaggaaggacggacccggaaggtacaccggtcttgttagtactttacgtgagacgaaggcggccgggtggacgggtaggttcggggatgactaactaccgtaagtacgttacggagttacgggcgtacggtcgggaaccgaagggtcccgacggtccaccggtctccgtacgacctcctaccgaaccggtaccgggtccctacgttccccggttacccttccccggtggacccccggtcccgtcggtacccctaccgggacgggtacccgtaccgtaccccgtagggggtccggggaaccctccggaaccgggccccggggttcccgtacggggacccgtttcgggaccccgtttaccgggggtaacgtaaaccccgggtttaacctttaccccggtttaaacgttaaacggttcctttacggttccgggttaccgg

SEQ ID NO: 152219 - DNA, 649 bp, Homo sapiens
  misc_feature: GYAE6OF01BRWHU.44.38.D05.1.454.CMB.1.raw
  modified_base (278)..(278): a, c, t, g, unknown or other
  misc_feature (278)..(278): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcgactcgtgaaggccatccacatctccagagacacgcaagaacacgctgtatctgacaaatgaacngtctgagacgccgaggacgacggtctgtgtattacgtgtcgacgaagcggccgggtggacgggtaggttcgggggagttcgctaacttacgtaacgtacgttacgggtagtacggggaccgttcggtcgggggacccgaacgggacccgtaccgggtccgacccggttcctaccccgtcgacgtcccgttacccgacccgaacgggtcccctacgtccggttcccttcccccgtcggcccgtcccgtcgccgtccgacggaccgccgtcccgtcggtccggggacctaccggacggcccgggtcccgtcgggccgttcggcccggtcggtacgaacggtaccttaccgttccgtacgcgtcggtccgtcgg

SEQ ID NO: 152220 - DNA, 265 bp, Homo sapiens
  misc_feature: GYAE6OF01DCRKV.44.38.D05.1.454.CMB.1.raw
  modified_base (255)..(265): a, c, t, g, unknown or other
  misc_feature (255)..(265): n is a, c, g, or t
tcagacagtatatacacgaccggtgctcgatttagtatctgatagttgggtttggggagttgcatactactactacggtatggacgtctgggccaagggaccacggtcaccgtctcctcagcttccaccaagggcccatcggtcttccccctggcgccctgctccaggagcacctctgggggcacagcggccctgggctgcctggtcaaggctacttccacgtctactgctgagcggctggcaaggcgcatagcnnnnnnnnnnn

SEQ ID NO: 152221 - DNA, 321 bp, Homo sapiens
  misc_feature: GYAE6OF01ADHHF.44.38.D05.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (308)..(321): a, c, t, g, unknown or other
  misc_feature (308)..(321): n is a, c, g, or t
tcagacagtatatacacgaccggtgctcgatttagtatctgatagttgggtttgggcaccgaggacacggctgtgtattactgtgcaagagccggtgcggagttcggggagttgcatactactactacggtatggacgtctggggccaagggaccacggtcaccgtctcctcagcttccaccaggccatcggtcttccccnggcgcctgctcaggancactgtggggcagcgccggcctgggctgcctggtcaaggtactacttcctatactcctgtctggaggcgggtctggcaaggcgacatagcnnnnnnnnnnnnnn

SEQ ID NO: 152222 - DNA, 704 bp, Homo sapiens
  misc_feature: GYAE6OF01BNR5S.44.38.D05.1.454.CMB.1.raw
  modified_base (147)..(147): a, c, t, g, unknown or other
  misc_feature (147)..(147): n is a, c, g, or t
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagacagtatatacacgaccggtgctcgatttagtatctgatagtggagtccgggggaggcttagttcagcctgggggggtccctgagactctcctgtgcagcctctggattcaccttcagtagctactggatgcacgtgggtccnccaagctccgaggggaagggctggtgtgggtctcgacgttattaatagtgagtgggagtagcacgaagctacggcggactccgtgaacggccatcaccntctcagacgacaacgccaagaacacgctgtactctgacaaatgaacngtcngacgngccgaggacacggtctgtgttactacgtgtcgacgtaaggacggtccggtggggtacgggtagggttcgggggtagttcgactacttacgtaacgtaacgtaggtagttcggacgtcgtacggggaccgaacgggaccgtacggtaccaccgttcctccctcgtacgtccgttaacccgacccgtaacgggccccgtaacgttccccgggttcccgttacccccggtcgggtccccgtcccgtcgtacccgttccggaacggtccgtacccgtacccggtcggtccggggaaccacccggcggcccgggtcccggtacgggtccgttccggtcccggttacgggtaacccgtaacggttaacccggttccttaccccggacgtttacctcgttggtacccgg

SEQ ID NO: 152223 - DNA, 572 bp, Homo sapiens
  misc_feature: GYAE6OF01EPKJ3.44.38.D05.1.454.CMB.1.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (459)..(459): a, c, t, g, unknown or other
  misc_feature (459)..(459): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
tcagacagtatatacacgaccggtgctcgatttagtatctgatagtggagtccgggggaggcttagttcagcctgggggggtccctgagactctcctgtgcagcctctggattcactttcagtaacgcctggatgacctgggtccgccaggctccgagggaaggggctggagtgggttggccgtattagaaccaaagctgacggtgggacagcagactacgctgcacccgtgaaaggcagattcaccatcctanaagagatgattacaaaaagatacggtntctctgcagatagaacagcctagaaccaccggaggacacacgccgttactattactgtcgtggtattggttcagttccggaccgaacgggtaaccctggtaccaccgtctcctacacgccctaccgaccgaacgggccctagtccgtccttccccgtgccgcctcgcctcgacggacnccaccgtccgagacgccgacgcggccggccgtggcctcggccgtacgtacgacgtaccttacttctatacgtactgtcgtggacggcggtcgaggacgaggcganagngnngn

SEQ ID NO: 152224 - DNA, 311 bp, Homo sapiens
  misc_feature: GYAE6OF01CZ2XJ.44.38.D05.1.454.CMB.1.raw
  modified_base (308)..(311): a, c, t, g, unknown or other
  misc_feature (308)..(311): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagacctctgggggcacagcggccctggctgcctggtcaaggactacttcctatatactgtctgagcgggctggcaaggcgcatagnnnn

SEQ ID NO: 152225 - DNA, 265 bp, Homo sapiens
  misc_feature: GYAE6OF01BG6HF.44.38.D05.1.454.CMB.1.raw
  modified_base (254)..(265): a, c, t, g, unknown or other
  misc_feature (254)..(265): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttccccctggcgccctgctccaggagcacctctggggcacagcggccctgggctgcctggtcaaggctacttccacgtctactgctgagcgggctggcaaggcgcatagnnnnnnnnnnnn

SEQ ID NO: 152226 - DNA, 696 bp, Homo sapiens
  misc_feature: GYAE6OF01AI7JY.44.38.D05.1.454.CMB.1.raw
  modified_base (155)..(155): a, c, t, g, unknown or other
  misc_feature (155)..(155): n is a, c, g, or t
  modified_base (288)..(288): a, c, t, g, unknown or other
  misc_feature (288)..(288): n is a, c, g, or t
  modified_base (488)..(488): a, c, t, g, unknown or other
  misc_feature (488)..(488): n is a, c, g, or t
  modified_base (527)..(527): a, c, t, g, unknown or other
  misc_feature (527)..(527): n is a, c, g, or t
  modified_base (551)..(551): a, c, t, g, unknown or other
  misc_feature (551)..(551): n is a, c, g, or t
  modified_base (685)..(685): a, c, t, g, unknown or other
  misc_feature (685)..(685): n is a, c, g, or t
tcagacagtatatacacgaccggtgctcgatttagtatctgataggtggagtccgggggaggtcttagttcagcctggggggtccctgagactcctcctgtcgcagtcctcgtggacttccacctttcagtgcctactggatgcacgtgggtccnctaagctccgagggaagggctggtgtcggtcctctacgttattaataggtaggatggggatacgcacagctacgccggtactcggaggacgggcctatccacatctaccagaacgacaacgccaagtaacgcnctagtaactctagaccaagtcgtaacagtcctaggacgtacgaccgggtaacgaccgacggcttaggtacttacttacgtggtacgagtaacggccggtacgggtgggacgggtgttaccgggggtattcgactatacgtacctacgtacggtatcggaccttgcgggaccgtacggactcggacaccgtctcctagtcncctaccgacgacggtacctacgtcggttaccctcccggnggccgtcccgtcgtacccgtacgnggtaccctaccgtacccgtacgggtgggacccgtaacgccggtacccgggtcccgtacgggtcgtcccggccggtttcgggaacccgtacggtacccctttaaccgttacccttaactacccggttttacccgngttaccccggg

SEQ ID NO: 152227 - DNA, 314 bp, Homo sapiens
  misc_feature: GYAE6OF01B0XZZ.44.38.D05.1.454.CMB.1.raw
  modified_base (309)..(314): a, c, t, g, unknown or other
  misc_feature (309)..(314): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 152228 - DNA, 205 bp, Homo sapiens
  misc_feature: GYAE6OF01D55HC.44.38.D05.1.454.CMB.1.raw
  modified_base (194)..(194): a, c, t, g, unknown or other
  misc_feature (194)..(194): n is a, c, g, or t
  modified_base (199)..(205): a, c, t, g, unknown or other
  misc_feature (199)..(205): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggcctcgccccctcggtcactctcgttccccgccctcctctatatactgtctggagcgggctaggcaaggccgnatagnnnnnnn

SEQ ID NO: 152229 - DNA, 582 bp, Homo sapiens
  misc_feature: GYAE6OF01AY9HO.44.38.D05.1.454.CMB.1.raw
  modified_base (144)..(144): a, c, t, g, unknown or other
  misc_feature (144)..(144): n is a, c, g, or t
  modified_base (261)..(261): a, c, t, g, unknown or other
  misc_feature (261)..(261): n is a, c, g, or t
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
  modified_base (507)..(507): a, c, t, g, unknown or other
  misc_feature (507)..(507): n is a, c, g, or t
tcagacagtatatacacgaccggtgctcgatttagtatctgatagtggagtccgggggagcttagttcagcctggggggtccctgagactctcctgtgcagcctctggattcaccttcagtagctactggatgcactgggtccnccaagctccgagggagggctggtgtgggtctcacgttattaatagtgatgggatagcacaagctacgcgactccgtgaacggccattccacatctccagagacaacgccaagaaccncgctgtatctgacaaatgaactagtctgagcgccgaggaccaggcttgtgttacttacgtgtcgacaaaggtcggaccgggttggcgggtaggtttccggggattcgactaatacgtactacgtacggtatcggacgttcgacgggacccgacggacctacggtccaccgtctccncacgtcctaccgaccacgggtccctacgtccgtcccttccccgnggcccgccctcgcctaccgacgtacnccgtccgcggtacgggccacggcggccgaccgtggccgtcgcgtcgaccgacgtacctactcctatactctgtcg

SEQ ID NO: 152230 - DNA, 734 bp, Homo sapiens
  misc_feature: GYAE6OF01DO456.44.38.D05.1.454.CMB.1.raw
  modified_base (146)..(146): a, c, t, g, unknown or other
  misc_feature (146)..(146): n is a, c, g, or t
  modified_base (211)..(211): a, c, t, g, unknown or other
  misc_feature (211)..(211): n is a, c, g, or t
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagacagtatatacacgaccggtgctcgatttagtatctgatagtggagtccgggggaggcttagttcagcctgggggggtccctgagactctcctgtgtcgcctctggattcaccatcagtgaccactatatggactgggtccnccaggctccaggggaaggggctggagtggcttggccgacaagtaaaaacaagttgccagctttancacagagtacgccgcgtctgtagaaagccagacttccaccctntacaagagatgacttacaaagaactcattgatttcngacgtaatcgaacctaacctaggaaaacccggnggaccgtacgggactagtagttaatttagtttgttggtttgttagtttaanattacgaaggtaacttcgtacccgacggttcggggacctaacgggggtaacccttgggtacccacccggtttcctaccctcgtaccggccccttacccgaacccggtaaccgggcccctaacgttccccgggttacccctttccccccggtacgggtccccgtccccgtcgtcccgttacccggacggaccgtaccctacccgtcccggaacggacgtacccgaaccgacggtccccggtccggtcgggtacccgtcggtccgtacgggtaaccgaacggttaacccttaccgtttcctaagttactacgttcggtcgtcggaacgggcgggtaccgtacgggacaacgggcgcgtaagg

SEQ ID NO: 152231 - DNA, 773 bp, Homo sapiens
  misc_feature: GYAE6OF01CECF1.44.38.D05.1.454.CMB.1.raw
  modified_base (393)..(393): a, c, t, g, unknown or other
  misc_feature (393)..(393): n is a, c, g, or t
tcagacagtatatacacgaccggtgctcgatttagtatctgatagtggagtccgggggaggcttagttcagccgtgggggggtccctgagactctcctgtgcagcctctggattcaccttcagtagctactggatgcacgtcgggtcccgaccaagccgtccgaagggggaagggctgggtgtgggtctcgacgttaattaaataggtgagtgggagtagacacgaaagccgtaaccggccggaaccgtccggtagggaacgggccgtaattccaaccagtcctaccgagaacgaccaaccgaccaaagaacacgcttagtatcctagaactaaataggaacagtctaggaacggacgaccgagaaaccggcggtcttagtataacgtttcgnggtacgacgaaggacgggccgggggtggtacgggggttaggtttacgggggaagtttccgaactaacgtttaacctacggttaacgtacgggttagtccgggtacgttcgggacgggaaccgaacgggaccgtacggtacctacccgtcctccgtacgtacgtaccctaccgaccgtaccgtaccgtaccgttcccggttaccccgttccccggtacggtcccgtcccgtacgtcccgtaccggaacgtccgaccgtaccggtaccgggtcggacccgagggcccggcccggtccgggtaccggtcgaccgggttccgtacgggtcccgtaaacggttcccgttaccgtttcccgtaccgtacgttcccggccgtacggg

SEQ ID NO: 152232 - DNA, 261 bp, Homo sapiens
  misc_feature: GYAE6OF01A6HMT.44.38.D05.1.454.CMB.1.raw
  modified_base (255)..(261): a, c, t, g, unknown or other
  misc_feature (255)..(261): n is a, c, g, or t
tcagacagtatatacacgaccggtgctcgatttagtatctgatagttgggtttggggagttgcatactactactactctctggacgtctggggccaggggaccgcggtcaccgtctcctcagcctccaccaagggcccatcggtcttcccctggcaccctcctccaagagcacctctgggggcacagcggccctgggctgcctggtcaaggactacttccacgtctactgctgagcgggctggcaggcgcatagnnnnnnn

SEQ ID NO: 152233 - DNA, 263 bp, Homo sapiens
  misc_feature: GYAE6OF01C3R9Q.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctcgtgggggcacagcggccctgggctgcctggtcaaggctacttcctatatactgtctgagcgggctggcaaggcgcatagnnnnnnnn

SEQ ID NO: 152234 - DNA, 748 bp, Homo sapiens
  misc_feature: GYAE6OF01CS3NC.44.38.D05.1.454.CMB.1.raw
  modified_base (425)..(425): a, c, t, g, unknown or other
  misc_feature (425)..(425): n is a, c, g, or t
  modified_base (608)..(608): a, c, t, g, unknown or other
  misc_feature (608)..(608): n is a, c, g, or t
tcagacagtatatacacgaccggtgctcgatttagtatctgatagtggaggtccgggggagcttagttcagccgtggggggtccctgagctctcctgtgcagcctctggattccaccttcagtagctacgtggatgcacgtggtccgcaagctccgaagggagggctggtgtggtctacagttattaagtgtgagtgggatagacaacacgctacggcggtactcggtaggaacgggtcctattccaactactcctaccgaggaacgaaccgaaccgactaaacgaccgaccgtcttagtactcgtacgaactaaagacgaaacgtgtacgtaggacggaccgacggtaaggcctacggtcttaggttagttacttacgtgagaccgaaggcgggtcggtacgggtaggggtacggttaggggtnttcgacttaacgttacctaccggtaacgttaggtacgtcggggttacctcggggaccgggaaccgaacgggtacccgtaccggttaccaccggtccttacccgtcgtaacgtccccgtaccgaacccgggaaccggtcccttacggtccccggtttccccttacccggcgtacccgtcccgtnaccccggtacggacgggtaccctccggaccgttccgggggacgaccgacccggcgggtccggtcccgggtaggtccgtccgttaccggtacgggaccgttaacttacccgtttactactagttctacggttcgtaccggg

SEQ ID NO: 152235 - DNA, 319 bp, Homo sapiens
  misc_feature: GYAE6OF01C6XFS.44.38.D05.1.454.CMB.1.raw
  modified_base (259)..(261): a, c, t, g, unknown or other
  misc_feature (259)..(261): n is a, c, g, or t
  modified_base (264)..(264): a, c, t, g, unknown or other
  misc_feature (264)..(264): n is a, c, g, or t
  modified_base (272)..(319): a, c, t, g, unknown or other
  misc_feature (272)..(319): n is a, c, g, or t
tcagacagtatatacacgaccggtgctcgatttagtatctgatagttgggtttgggggagttgcatactactactacggtatggacgtctgggggccaagggaccacggtcaccgtctcctcagcttccaccaagggcccatcggtcttccccctggcgccctgctccaggagcacctctgggggcacagcggccctgggctgcctgggtcaaggctacttcctatatactgtctgagcgggctggcaaggcgcatagnnntgnagcatgcnnnnnnnnnnnnnnnnnnnnnnnnnnnnnnnnnnnnnnnnnnnnnnnn

SEQ ID NO: 152236 - DNA, 679 bp, Homo sapiens
  misc_feature: GYAE6OF01CS074.44.38.D05.1.454.CMB.1.raw
  modified_base (147)..(147): a, c, t, g, unknown or other
  misc_feature (147)..(147): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagacagtatatacacgaccggtgctcgatttagtatctgatagtggagtccgggggaggcttagttcagcctgggggggtccctgagactctcctgtgcagcctctggattcaccttcagtagctactggatgcacgtgggtccnccaagctccgaggggaggggcttgggtgtgggtctcacgttattaatgtgagtgggagtagcacaagctacggcggactccggtaggaacgggcctattccaccatcctaccaaggacgaccaacgaccaaagaaccacgctgtatctagaacaaatgaacngtctaggacgacggccggaggacgacggtctgtagttattacnggtagacgaaagggcggccgggtaggacggggtaggttaccgggggatttcgactaattacctacgttaacggtgttaagtcgggtaacgtcgggacggggaccgaacgggacccgacggtaccgtaccgtcctccctacgtacgtacctccgaaccgaacggtccctacgtccggtacccttccccggcgccgtccctcgccgtaccgacgggctccgtaccgtcgggtacgggaccacgggtacggcccgggtccggtcgggtcgtacggtaccggtggtaaccgaacggttaccttaccgttacgttagtaacctgtcgtacgg

SEQ ID NO: 152237 - DNA, 263 bp, Homo sapiens
  misc_feature: GYAE6OF01D173C.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcggctggcaaggcgcatagnnnnnnnn

SEQ ID NO: 152238 - DNA, 779 bp, Homo sapiens
  misc_feature: GYAE6OF01A0LUH.44.38.D05.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagctccgagggagggctggtgtgggtctcacgttattaatagtgatgggagtagcacaagctacgcgactcgngaaggccatcaccntcncagacgacaacgcaagacacgctagtactctagaccaaagtgaaactacgttcacggaaggacggacccggtaagggacctaccggggcttaggtacgttttaattacgtggtacgaacaacggacgggtccgggtggggcggggttaacgggttcggggtagttcggactaacgttaccttaacgttaacggttacggtaggttcggaaccggttaccgggacgggggtaacccggtaaccggggaaccgtacccggggtaccgtaaccccggttccctaccccgttacgaccggttacccttaccccgaaccggtaacccgggcccctaaccggttcccggttccccgttacccccggtcggtccccgtcccgtccgtcccgtccggtaacggccgtaccgtcccgtacgggcggggtaccaaccggtccggggtcccggtccccgggtcgggtccgtaccgggtaccggttccggaaccgtaacccgggttaccgttaacccgttccggtaaccgtttccccgtggtccggtacggg

SEQ ID NO: 152239 - DNA, 329 bp, Homo sapiens
  misc_feature: GYAE6OF01DSKIP.44.38.D05.1.454.CMB.1.raw
  modified_base (305)..(305): a, c, t, g, unknown or other
  misc_feature (305)..(305): n is a, c, g, or t
  modified_base (311)..(329): a, c, t, g, unknown or other
  misc_feature (311)..(329): n is a, c, g, or t
tcagacagtatatacacgaccggtgctcgatttagtatctgatagttgggtttgggcaccgaggacacggctgtgtattactgtgcaagagccgggtgcgggagttcggggagttagcatactactactacggtatggacgtctggggccaagggaccacggtcaccgtctcctcagcttccacaaggcccatcggtcttcccctggcgccctgctccaggagccaccgtcgtggggcacgagccggcctgggctgcctggtcaaggctacttcctagtatactgtctgagcggctggcaaggcncatagnnnnnnnnnnnnnnnnnnn

SEQ ID NO: 152240 - DNA, 622 bp, Homo sapiens
  misc_feature: GYAE6OF01A4LAW.44.38.D05.1.454.CMB.1.raw
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccgccaagctccgagggagggctggtgtggtctcacgtattaatagtgagtgggagtagcaacaagctacgcggactccgtagaacgggccattccaccatccnccagacgacaacgccaaagaaccacgtctagtatctgacaaagtcgaaacagtcagagacgcgaggacacggcttagtcgtaattacgngtagacgtaaaggcggcccgggtggacgggtaggttcggggattgctaatacgtactacgtacgtatcggactcgtagggaccgaggacgacgtcaccgtctcgtacacgtctaccgacgtacggcctacgtccgtaccttccccgtgcccgtccgtcgccgtaccgacgaccgtaccgtaccgtcggacgggacaccgacggcccggtccgtcgggtcgtcggtccggtacggtaccggtaaccgtaccgttaccgttaccttaattacgttacgttggtaccgg

SEQ ID NO: 152241 - DNA, 980 bp, Homo sapiens
  misc_feature: GYAE6OF01BHKQO.44.38.D05.1.454.CMB.1.raw
tcagacagtatatacacgaccggtgctcgatttagtatctgatagtggagtccgggggaggcttagttcagccgtgggggggtccctgagactctcctgtgcagcctctggattcaccttcagtagctactggatgcacgtgggtccgcaagcgtccgaggggagggtctgggttggtcgggtctcgacgttaattaagtaggtgaggttcgggagtacgacaacgaagcgtaccggcggtacctccgggtaggaacggggcctattaccaacctattccgtaccgaagaacgaaccgaaacggacctaaaggaacctacgtacgtaggttaactacgttacgaacgtaaacgttacgaacgtacggttccgtaggaaccggacggaccgggaaggacccggtacgggttactttacgggttaacgtttaacgtttaccggtcgggtaacgaaccggtaacgggtaccggggtaccgggggtacggggttacgggggttaacggggtttacgggggggtaacgtttacggtaccgttaaaccgtttaaacccgtttacggtaaacccgggtttaacgggttacgggtaacggggttaaccgggttaggggttaacccgggggaaacccgggtaaccggggtaaccccggtaccgggttacccggttaccccggttccgttaccccggtaccggtaacccggttacccttaaccccggaacccgggtaccgggtaccccgttaccgtttccccggtttaccccgtccccgggttcggtaccccgtcccggttacccgtaacccggtaccggtaacgggtacccgtccgttaacccgggtccgggtaccggggacccgtacgggtacccggtccggggtaaccccggtgggtacccgttcgggtacccggttacgggtaccgttaaccggttacccgtttacccgggtacgttacccggtccgggtaccgtcgggttaccgg

SEQ ID NO: 152242 - DNA, 313 bp, Homo sapiens
  misc_feature: GYAE6OF01EZCAB.44.38.D05.1.454.CMB.1.raw
  modified_base (173)..(173): a, c, t, g, unknown or other
  misc_feature (173)..(173): n is a, c, g, or t
  modified_base (262)..(313): a, c, t, g, unknown or other
  misc_feature (262)..(313): n is a, c, g, or t
tcagacagtatatacacgaccggtgctcgatttagtatctgatagttgggtttgggggagttgcatactactactacggtatggacgtctggggccaaagggaccacggtcaccgtctcctcagcttccaccaagggcccatcggtcttccccctggcgccctgctccaggancacctcgtgggggcacgagcggccctgggctgccgtggtcaaggactacttcctatatactgtctgagcggctggcgaagcgacagagnnnnnnnnnnnnnnnnnnnnnnnnnnnnnnnnnnnnnnnnnnnnnnnnnnnn

SEQ ID NO: 152243 - DNA, 738 bp, Homo sapiens
  misc_feature: GYAE6OF01C1O9Z.44.38.D05.1.454.CMB.1.raw
  modified_base (416)..(416): a, c, t, g, unknown or other
  misc_feature (416)..(416): n is a, c, g, or t
tcagacagtatatacacgaccggtgctcgatttagtatctgatagtggaggtccgggggagcttagttcagccgtggggggtccctgagactctccgtgtgcagtcctctggtacttccaccctttcgagttagccttacgtggattcgcctacggttcgggtacccgacccaagtccgtaccggaagggggtaacgggtcttgggtggttcggtcctaccgtagttaattaagtaggtgtaggttagggagtgaccaacgaacgtccgtaccggaccgacgtccggtagggaaccggtcctaattccaacctatccgacaaggacaaccgaaccgacgtaaaacgaccacggtcctagttactctacgaaactaagtacgaactggtccagaacgcgaccggagcgacgtcgttntataacgtctagggcaacggaaggcggtcgggtagggacgggtttaggtcgaaggtcaactacggtcaacgttcgtaaggtcgcggtacggtcggaccgggacggaccgtaccggcctacctcctaccgtcaggtaccacccgtacgcgtaccggtccacgttcccgtacccgccgtcgctccctgccgtacccgagccgtaccgtaccgggtcggaccggtaccgtaccggcccgggtacctccgggtccggccgttaaccgtccgggtaacgtacccgtaaactttcggtaccccttaattacgccttagggtcctacgg

SEQ ID NO: 152244 - DNA, 805 bp, Homo sapiens
  misc_feature: GYAE6OF01B0SQS.44.38.D05.1.454.CMB.1.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
tcagacagtatatacacgaccggtgctcgatttagtatctgatagtggagtccgggggaggcttagttcagcctggggggtccctgagactctcctgtgcagcctctggattcaccttcagtagctacgtggatgcacgtgggtccgccaagctccgaggggaagggctgggtgtgggtctcgaacgttattaagtagtggagtggggaatagcaacgaagcctacgcgactcgaggaggcatcacntcncaganacacgacaagacncgctgtanctagacaaatcgaacagtcagggaacgagcccggaagaccgtacggtcgtgttagtattacgnggtagaacgaagggcggtccgggtggggacggggttaggtttcggggagttacgataacttaccgttaaccgttacgggttaaggtagtcgggaccggttcgggtacggggaacccggaacgggtaccgaccggtccgtacccgttccgtacccgtcgacgttacccgttacccgaacccgggaaccggttacccacggtttccccgttacccgttcccccggttacggcccccgttcccgtcgtacccctacccgggaaacgtcccggtaacccgtacccggttaccgggggtaccggggaaccccaccgggtacccggggtccccgggttacccccgggtgggtccccgttacccggggcccggtttaaccgggaacccggtttaaaccgggtttaacccccgttaccccggtttaccccgttaacggggcccgtttacccccggggttggttaaaccccgggg

SEQ ID NO: 152245 - DNA, 708 bp, Homo sapiens
  misc_feature: GYAE6OF01BQEOE.44.38.D05.1.454.CMB.1.raw
  modified_base (311)..(311): a, c, t, g, unknown or other
  misc_feature (311)..(311): n is a, c, g, or t
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtagggggtccctgacgactctcctgtgcacgcctctggattcaccttcgataattggaatatgcagtcgggtccnccgaggctcgaggcgagggctgggagtgggtggcgaggtgtgtctatttcagtggaaggaatcgaaagttcgtaacggtgtacgtttccgttagggacgggtcctaattccacctaattccgtaccgaacgtaacgaaccgtaaacgtttaccggaaacgaaccgtaacgtaggttacgttacctactttaaccaaagttacgaaaccgagtaccctaggaaccgtaacccgttacgtaaccgggacccgaaccgggttaccggttacgttttaaggtttttcgtaccggtaccggtaacggttaacccttacgtttccggtttaccgttttaaaccgtaaacgtttacccggtttactaacggtttcccggtaaccggtcccgggttacccggggg

SEQ ID NO: 152246 - DNA, 739 bp, Homo sapiens
  misc_feature: GYAE6OF01CT382.44.38.D05.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
tcagacagtatatacacgaccggtgctcgatttagtatctgatagtggagtccgggggatgcttagttcagccgtggggggtcccagagactctcctgtgcagcctctgggctcaccgtcagcagcaactacatgaggttgggtccgccaggctccgaaggggaaggggctggagtgggtctcagttcattttatactgggtntatttcactatacgtacgcagaacgtccgtggaaacgggccgtattccaccattccaccgaagggaacaacttaccaacggtaactacggtttatcttaacaaattacgaaacaaccgtgagacggcgaacgtacgaccggccttactaatttacgngtaggacgagaacgaacggttccggacgtacggttcgggaggtttaggttttaatttacgtttaccggtttgaaccgttttcggacgggggacccgtaacggggtaaacccttcgggtaccctacccggttccgtcccgtccccggtacccgtacccacccggaaccggcccgttacgttcccggttccccgttcccccgtcgggacccctaccccggtacccttaccgaacgtccgaccctaccgttccggtccggggacaacccggcggtcccggccgggtccgggtccgtccgccgtggtacgaaccgtccgttacctaccgtaattacgtacgtcggtctggacgtccgggacgtcggacgaaggctcgaagtcg

SEQ ID NO: 152247 - DNA, 827 bp, Homo sapiens
  misc_feature: GYAE6OF01EUP2A.44.38.D05.1.454.CMB.1.raw
  modified_base (211)..(211): a, c, t, g, unknown or other
  misc_feature (211)..(211): n is a, c, g, or t
  modified_base (708)..(708): a, c, t, g, unknown or other
  misc_feature (708)..(708): n is a, c, g, or t
  modified_base (721)..(721): a, c, t, g, unknown or other
  misc_feature (721)..(721): n is a, c, g, or t
tcagacagtatatacacgaccggtgctcgatttagtatctgataggtggaggtccgggggaggcttagttcagccgtcggggggtccctgagactctcctgtgcacgccgtctggtattccgaacctttcagtacgctaactggactcgcacgtcgggtccacgaagccgtacgaggggtacgggcgtggtgtcggtctctacgttatagngtggagtggatagctaacgacgctacggacgtctacggacggacgtctataccactactctacgaagaccgaacaacgtaccgaaacgtacgaccgtgttacgtactccgtacgaaactaaacgtacggaaccgtagttcggaacggaaccggacggtacccgggaaacggtaccggacggttcgtttttttacggaacgttaacgttttccggacggtacgaaacgggtaaccggtaccggggttcggggaaccggggttaccggggttaaggggttgggttaaaccgcggtaaaacctttaaccgtttaaaaccgggtaaacctttacggggttaaacgggtaccgtttaacggggaccggttaccgggaccggggtaaacgtaacccggtaaccgggtacgtccccgtaccggttaccctcggtaactacgtcccgaaccgtaaccggacccgtactccggttacccgtcccttcccggtacgcccgccgtacncccgggtaacccngggtaccctacgtcggtacggcggaaccttcggacccggtccggacggttcgaccgtgttacggctaccgtaacgtccgttcccagttacgacttacgcgtaacgg

SEQ ID NO: 152248 - DNA, 707 bp, Homo sapiens
  misc_feature: GYAE6OF01C58EZ.44.38.D05.1.454.CMB.1.raw
  modified_base (121)..(121): a, c, t, g, unknown or other
  misc_feature (121)..(121): n is a, c, g, or t
  modified_base (191)..(191): a, c, t, g, unknown or other
  misc_feature (191)..(191): n is a, c, g, or t
  modified_base (369)..(369): a, c, t, g, unknown or other
  misc_feature (369)..(369): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (697)..(697): a, c, t, g, unknown or other
  misc_feature (697)..(697): n is a, c, g, or t
tcagacagtatatacacgaccggtgctcgatttagtatctgatagtggagtccgggggaggcttagttcagccgtggggggtccctgagactctcctgtgcagcctcgtggattcaccttnagtagctatggatgcactgggtccacaagctacgaaggggagggctggtgtggtctcaagtattaatagngagtgggatagcaacgaagcgtacggcggtactaccggaggaacggcctattaccaaccgtctccgtaccaaggacgaaccaaacgtaccaaagaactacgcttagtactcgtagaacaaaagtcgaaacctgtacgaggacgacgtccgaagaccaggtcttagtacgtaattacgnggtcgaacgtagacggtccgggtaggacggtacggtaggtattcgactattaccgtanaaccgttagacggngtcgtacggtcgggaaccgacggaccgtacggtcccgaacgtcctaccgtcgacgtccctaccgaacgtaccggtccctacggtcccgttcccgtcccgacgtcccgtccgtcgaccctaccgagggtaccctccgtaccgggtccggtacgggacctacggacccgggttccgaccccgggttcggtcgtcccggtaccgttcgggtaaccggtaaccgttacccgttaccgttacccttaaccgttccgtacgngttaccgggg

SEQ ID NO: 152249 - DNA, 774 bp, Homo sapiens
  misc_feature: GYAE6OF01AUCFA.44.38.D05.1.454.CMB.1.raw
tcagacagtatatacacgaccggtgctcgatttagtatctgatagtggagtccgggggagcttagttcagcctggggggtccctgagactctcctgtgcagcctctggattcacctttcagtagctactggatgcacgtcgggtccgccaagctccgaggggagggctgggtgtggtctcgacgttattaagtagtgagtgggagtagcaacgaagctaccgcggactccggtaggaacgggcctattccacctatcctaccaggacgaaccaaccgaccaaacgaacctaccggtcttagtaactcctaggaacctaaaatacgaaacgtacgttcgaacggaacggacggacccggtaaggaaccctaggggtcttaggtacgttacgttacgtgtacgacgaaggcggtccgggtggtacgggtggggttacggggacttaggaccgtaacttaccgttaacgtaacggttaacggttacgtacggggtaacgttccggggtacggggaaccccggaacggggtacccgtaacccgggttacgtaccccgttccgttacccgtacgtaccgttcccttaacccggaaccgggtaacccgggtcccctacgttttcccgggttacccccttcccgtcggcccctccgtctacccgtcgacggtaccgcctacccgggtcggtacgggacctaccggaccggtcccggtaccggtcggccgtcgaccgttaggacccgtaagtacccctttgtaactataaccttgtgtccgg

SEQ ID NO: 152250 - DNA, 812 bp, Homo sapiens
  misc_feature: GYAE6OF01ART48.44.38.D05.1.454.CMB.1.raw
  modified_base (327)..(327): a, c, t, g, unknown or other
  misc_feature (327)..(327): n is a, c, g, or t
tcagacagtatatacacgaccggtgctcgatttagtatctgatagttgggtttggggggaagaggaagactgacggtcctcccaggagttcaggtgctgggcaccgttcgggcacgggggaggcttagttcagccgtggggggtccctgagactctcctgtgcagcctctggattccaccttcagtacgctactggatcgcacgtcgggtccgccaagcctccggaggggaagggctgggtgtcgggtctcacgttattaagtagtgagtgggagtagcaacaagctacggcggtacgtccggtaggaacggccattccacactccnccagacacaacgaccaagaaccacgtcgtagtactcgtacgactaaacgtacgaactaggttacgtagaacggaccggtaccggaacggaaccgacggtcgttagttacggttacttacgtcggtacggaacgaacgggtccgggtccgggttacgggtacgggggttacgggttaacgggggtagttcggtaacctaacgtttaaccgtaacggttaaccggtacgggttacgtacggggttaacccggtcggggtaaccggggtaaccgggtaaaccgggtaacccggtaccggttacccgtacccgttaccgttacccgaacgttaccggtttacccccgtaacccgaaccccgggtaaaccggtccccgttaaacgggttcccccggtttaccccgttcccccgggacgggtcccctcccggttacgtaccccgacgggtaacccggtcgacccggtcccggtggggtcccgggaaacccg

SEQ ID NO: 152251 - DNA, 690 bp, Homo sapiens
  misc_feature: GYAE6OF01A7IRW.44.38.D05.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagacagtatatacacgaccggtgctcgattttagtatctgatagttgggtttggggagttgcatactactactacggtatggacgtctggggccaagggaccacggtcaccgtctcctcagcttccaccaagggcccatcggtcttcccctggccgccctgctccaggagcaccgtcgtcggggcacgaggcggcccgtggggcctgccgtaggttaccgaaagggaaccttaaccgttttacctaattaacgttaaaccgttggtttaccttaggaacggccgggggtaccttacgggaaaccaaaacggggtccggaacctaaagttaggacacanacagacaggancaagcacagntacaagtnatagtagagcgacgacgacganacgacgacgacgnacgacgaggagacgtacgacgtacgcgacacanacgacaacgaatagacgtaagacgtagaacgtagtacgtataagtaagtactagtaacgtagactaactaacgttacgttaaccgtaacgtacgtacgtacgaacgtacgtaacggtacggaacgaacgaacggaacgtaaacgtaacgtaacgtaacggaacggcgtacgaacgtaagtaccgtaccggtcgtacgtaacgtccgtaacttacgacgtacgtacgtaacgtaacgtaaacgtaacggtaacg

SEQ ID NO: 152252 - DNA, 647 bp, Homo sapiens
  misc_feature: GYAE6OF01CCC1C.44.38.D05.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (496)..(496): a, c, t, g, unknown or other
  misc_feature (496)..(496): n is a, c, g, or t
tcagacagtatatacacgaccggtgctcgatttagtatctgatagtgggagtccggggagctagttcagcctgggggtccctgagactctcctgtgcagcctctggattcaccttcagtacgctactggatgcacgtggtccgcaagctccgagggagggctggtgtcggtctacacgttattaagtaggtgagttgggatacgcacagctacgcgactcgngacggccattcacntcncagagcaacgcaagacncgctganctganaatgaacngtcngacgacgaccgagacacggnttgtagttacttacgngtacgacgaagcggtccgggaggacgggtacgttaggggattcggacttaacgttacctacgttacgtacgtagtcggaccgttggaccggggacgtaacgggcctaccggtcctaccgtctaccgtacgacgtacctacccgacgaaccggtccctacgttcccgttcccgtaccccgnggtcccgtcctacggtcccgaccgacggtacccgcgtacccggttgggaccggtcacgccgggtcccgaccggttcggccgttcgaccggtttccggaccgtaaccggtacccttaccggttactaaccttcgttaccgtcggttacccgg

SEQ ID NO: 152253 - DNA, 725 bp, Homo sapiens
  misc_feature: GYAE6OF01BGMI5.44.38.D05.1.454.CMB.1.raw
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctctggattcaccttcgattaattggaatatgcaggtgggtccgccgaggcctccgagggcggaggggctgggagtgggtggcgagggtgtgtctatttcgagtagggaaggaaatcgaaagttcgtaacgggtgtaacgtttccggtaggacgggtccgtagttccacctactccgtccgaagtacgaaccgtaacgttaccggaacgaaacctaacgtaacgttacgttaccttaccgtttaacgtaaaactacgtaaacgtacggtacccttaggaaccgtacccgtaccggaacgggaaccgtacccgggtacccggttaggttttacgtttttcggtacggtaccggtaacgttaccgtttaacgttccgtttaccgtttaaacccgtaaaacgtttcccgggtttaaccttaacggtttacccggtacccggttcccgggttaacccgggggg

SEQ ID NO: 152254 - DNA, 936 bp, Homo sapiens
  misc_feature: GYAE6OF01DYM0G.44.38.D05.1.454.CMB.1.raw
tcagacagtatatacacgaccggtgctcgatttagtatctgatagtggaggtccgggggaggcttagttcagcctggggggtccctgagactctcctgtgcagcctctggattcaccttcagtagctactggatgcacgtgggtccgccaagctccgagggaacggggctggtgtgggtctcaacgtattaagtgtgagtgggagtagcaacgaagctacggcggtactccggtaggaacggggcctattccaaccattcctaccgagaacgacaaaccgtaccaaagaaccgacgtcttagtaactccgtagaactaaaagtcgaaactgttccgaagggaaggaccggaccgggaaggtaccgacggttcgtaggttagtttaactttacgtggtacaacgaaacggtcgggtccgggtaggggccgggttaacgggttcggggtaagtttcggaactttaataacccgtttagttaaaccgggttaacggttaacggtcggtaaacggttcgggaacgggggtaacccgaaacggggtaaccccgtacgggttaccctacccggtttcccgttacccgttaaccctaaccgtaacccgaacccgggtaaccgggtcccttaaccggtttccccggttacccctttccccccggtcgggtaccccgttacccccgtacggttaccccgggaccggtaaccgggtaacccggtcccgttaaacccgggttccgggaaccgggggtacccctaaacccgggcccggggttccccggggttaccccggtaccgggggttccccggttaccgggttaacccccgggttacggggtaaccccgttaaaaccccgggttaacccctttttaaacccggttaccccgggttaaaccccttaccggttttaaccccgggcggttcccgggttaacccggggg

SEQ ID NO: 152255 - DNA, 342 bp, Homo sapiens
  misc_feature: GYAE6OF01B7W3E.44.38.D05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (299)..(342): a, c, t, g, unknown or other
  misc_feature (299)..(342): n is a, c, g, or t
tcagacagtatatacacgaccggtgctcgatttagtatctgataggttgggggtttggggagttgcatactactactacggtatggacgtcgtgggggccaaaggggaccacggtcaccgtcctcctcagccttccaccgaacgggcccaagtccggtccttccccctgggcccgccctgcctccgaggagccaccgtcgngggggcacgnggccggcccgtgggctcggccgtggtacaacggtcttaacttcctaatatactgtctggaggcgggtctaggcgaagggcagaagtgnnnnnnnnnnnnnnnnnnnnnnnnnnnnnnnnnnnnnnnnnnnn

SEQ ID NO: 152256 - DNA, 196 bp, Homo sapiens
  misc_feature: GYAE6OF01ESROV.44.38.D05.1.454.CMB.1.raw
  modified_base (191)..(196): a, c, t, g, unknown or other
  misc_feature (191)..(196): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgccccctcggtcactctgttcccgccctcctctatatactgtctgagcggctggcaaggcgcatagnnnnnn

SEQ ID NO: 152257 - DNA, 766 bp, Homo sapiens
  misc_feature: GYAE6OF01AZ7A2.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagctccgaggggaagggctggtgtgggtctcacgtattaatagtgagtgggagtagcacaagctacgcggactccgtagaacgggccgattccaccatcctaccagagacaacgccaagaacacgctgtatctgacaaatagaacgtagtctaggagaggccgaggaaccgacggcgttgtagttacttacgtggtagaccgtaaaggacgggtcccgggtagggtacgggggtaagggtttcggggggtaagtttggacctaacgttaaaccgttaacgttaacggttaacgggttacggtacggggtaacggttccggtacgggggacccgaaacggggtacccgtaaccggttccgaaccgttcccgttacccgtacgtacgttcccttaacccgaacccgaaccgggtcccctacgttccccggtaccctttcccccggaggtcccccgtccgtaacggcccttacccggacgggtacccgtccgtacccggttcgggtaccggggaccctaccgggcgggtccccggtcccggtgggtacccgttcggacccgggtacggtaccgaaaccggttccttaacccgttacttaagttccttaccggtgtaccgg

SEQ ID NO: 152258 - DNA, 779 bp, Homo sapiens
  misc_feature: GYAE6OF01ELDS8.44.38.D05.1.454.CMB.1.raw
  modified_base (147)..(147): a, c, t, g, unknown or other
  misc_feature (147)..(147): n is a, c, g, or t
  modified_base (269)..(269): a, c, t, g, unknown or other
  misc_feature (269)..(269): n is a, c, g, or t
tcagacagtatatacacgaccggtgctcgatttagtatctgatagtggagtccggggggaggcttagttcagcctgggggggtccctgagactctcctgtgcagcctctggattcaccttcagtagctactggatgcactgggtccnccaagctccgagggaggggctgggtgtgggtctcacgtattaatagtgagtgggatagcacaagctacgcggacctcgtaggaacggcctattccaccatctcagacgacacgacaagaacncgctgtactctagacaaatgaactagtctaggagacggccggaaggacgacgggctagtgttattagttgttgtttagttagtttatactaggtaacggtaccttcggtacccgacgggtacggggacccgtaacggggtacccttgggtaccctaccggttccttcccgtacgacccgtcccctacccgaaccggtaaccgggtacccttacggttccccgggtttacccccttcccccggtcgggtccccgttccccgtacggtacccgttaccggaacgggtacccgacccgtacccgtaacggacgaccgaccgaccggaccgggtccccgggtccggtcgggtaccgtccgggtaccggttaccggtaccgtaaacggttacccctttaaccgtttaccccgttaagtttaaacccgtttaccgggttacgttacccgggtaacgggacgggggttacccgggcggttaaccggggaacccgggttaacggggcccgtaaacggg

SEQ ID NO: 152259 - DNA, 724 bp, Homo sapiens
  misc_feature: GYAE6OF01DW2NN.44.38.D05.1.454.CMB.1.raw
  modified_base (210)..(210): a, c, t, g, unknown or other
  misc_feature (210)..(210): n is a, c, g, or t
  modified_base (267)..(267): a, c, t, g, unknown or other
  misc_feature (267)..(267): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
tcagacagtatatacacgaccggtgctcgatttagtatctgatagttgggtttggggggaagaggaagactgacggtcctcccaggagttcaggtgctgggcaccgttgggcgacgggggaggcttagttcagccgtggggggtccctgagactctcctgtgcagcctctggtattcaccttcgagtagctacgtgatgcacgtggtccnccaagctcgaggggaggctggtgtggtctctacgttattaatagtgagtgggatacncacgaacgctacggcggtaccgtacgtaggaacggtccgtattaccacctagtccctacgagaacgaaccaaccgaccgaaacgacacgtntagtactcanaactaatagactagtcgaggacgacgacggagacgtcggtcgttagttacgtattcgtgtagaacggaaggcgggtcgggtacgggccgggttaagggttcgggtagttacacgtaacttaacgtccgttaacgtacggttacggtcgggaacggttccgggaaccggggaccgaaccggggtaccgaaccgttcccgaccggttacctccggtacgtaccctcccgttaacccgaaaccggtcccggtccctacggtttaccccgttccccccggttcccggaccggccccggttacctccggtacccgtaacggcggtaacccgtcccgtaaccgggtgggtcccgggaacccg

SEQ ID NO: 152260 - DNA, 339 bp, Homo sapiens
  misc_feature: GYAE6OF01DF3Q2.44.38.D05.1.454.CMB.1.raw
  modified_base (306)..(306): a, c, t, g, unknown or other
  misc_feature (306)..(306): n is a, c, g, or t
  modified_base (326)..(339): a, c, t, g, unknown or other
  misc_feature (326)..(339): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcctccaccaaggcccatcggtcttccccctggcaccctcctccaagcgcacctcgtggggcacacggccggcccgtggcctcgcccgtggtacaaggaccttacttcctaatactactgtctgagccgggntggacaaggcgacagtacgnnnnnnnnnnnnnn

SEQ ID NO: 152261 - DNA, 311 bp, Homo sapiens
  misc_feature: GYAE6OF01AP2JR.44.38.D05.1.454.CMB.1.raw
  modified_base (157)..(157): a, c, t, g, unknown or other
  misc_feature (157)..(157): n is a, c, g, or t
  modified_base (264)..(311): a, c, t, g, unknown or other
  misc_feature (264)..(311): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcnccctgctccaggagcacctctgggggccacagcggccctgggctgccctgggtcaaggactaccttcctatatactgtctgagcgggctggccaaggcgcgatacgnnnnnnnnnnnnnnnnnnnnnnnnnnnnnnnnnnnnnnnnnnnnnnnn

SEQ ID NO: 152262 - DNA, 303 bp, Homo sapiens
  misc_feature: GYAE6OF01AJ8MJ.44.38.D05.1.454.CMB.1.raw
  modified_base (176)..(176): a, c, t, g, unknown or other
  misc_feature (176)..(176): n is a, c, g, or t
  modified_base (271)..(303): a, c, t, g, unknown or other
  misc_feature (271)..(303): n is a, c, g, or t
tcagacagtatatacacgaccggtgctcgatttagtatctgatagttgggtttggggagttgcatactactactacggtatggacgtctggggccaagggaccacggtcaccgtctcctcagccttccaccaagggcccatccggtcttccccctggcgcccctgcctccaggacncacctcgtgggggcacgacgcggcccgtgggctcgcctggtcaaggtactacttcctatatacgtgtctgaggcggcgtgcgaggcgacagtagnnnnnnnnnnnnnnnnnnnnnnnnnnnnnnnnn

SEQ ID NO: 152263 - DNA, 1007 bp, Homo sapiens
  misc_feature: GYAE6OF01ERVHW.44.38.D05.1.454.CMB.1.raw
tcagacagtatatacacgaccggtgctcgatttagtatctgatagttgggtttggggggaagaggaagactgacggtcctcccaggagttcaggtgcgtgggcaccttgggcacgggggaggcttagttcagccgtggggggtccctgagactctcctgtgcagtcctcgtggattcaccttcagtagctactggatgctacgtcgggtccgaccgaagccgtaccggaagggggaacggggtcgttgggttggttacgggttcctacgtaacgttaatttaaagtaggtaggtagtacggggtagttagaccaacgaacgtccgtacggccgggtacctacccgggtaggaaaccgggccgttaccgttaccaaccctagttacctaccgaaggacgaaaccgtaaccgaaccgtaaaacgaaccgtacgtacgttagttaacgtaccgttaggaactaaaagtacgaaaccgtcgtacggtaaggaacggtacgggaacccgggtaacggaacccggtacgggtactttacggtttaaggttaaacgtttacccggtgggtaacgggaaacccgtaaagggggtacccgggggtaccgggggttacggggttaacggggggttaacgggggtttacgggggtttaacgggttacgtaaccggtttaaccgttaaacccgggtttaaccgttaacgggttaaaccgggtttaacgggtaccggggttaaccgggttacccgggggtaaccggggggtaaccccgtaaaccggggtaacccggtaccccgggttaacccggtacccgttacccgtacccgttaccgtacccggttaccccgttaaccccggaaacccgtaacccgggacccccgttaccggttaccccggggtttccccgtttaccccccggggtacggttcccccggtccccggttcggaccccggtttacccggaccgggtacccttaacccggtcccgggttcccggggccggggtaaccccgg

SEQ ID NO: 152264 - DNA, 847 bp, Homo sapiens
  misc_feature: GYAE6OF01EQP2I.44.38.D05.1.454.CMB.1.raw
tcagacagtatatacacgaccggtgctcgatttagtatctgataggttgggtttggggggaagaggaagactgacggtcctcccaggagttcaggtgcgtgggcaccttgggcgacgggggaggcttagttcaggccgtggggggtccctggagactctctgtgcagcctctggattccaccttcagtagctactggatgcacgtgggtcccgccaagcctccggaaggggaaggggctgggtcggtgggtctacgtaacgttaattaagtagtggagtaggggagtaggactaacaaacggtcgtaccggccgggtaaccttcccgggtagggaacgggtcccgtaattccaaccccgtacgtccctccaaacggaccgaaacgaacccgaccgaaaagaccacccggtcttagtacctactacgaataaaacgttccgaaaacgtagttcgtaaggaacggaccggtacccgggaacggtaccgtaacggggtctttcgggttaaacgttttacgttaaccggtaggtaccgaaaccggaggggtacgggacccggggtaggggtccgggggttaacggggttcggggggtttacgttacggaccgtaacgtttaaaccgtaaccggttaaccgggttaagggttaacggtccggggttacggttaccgggacccgggggtaaccgaaccggggacccgtaacggttcccgacccggttaccgttcccgtacaacgttcccgtaaccgaaccgaccggtaccctaccggtccgtaccccgttccccgcggccccgtccgtccggccgtacggaccgtaccgccgtacccgtggggaacgggcccg

SEQ ID NO: 152265 - DNA, 285 bp, Homo sapiens
  misc_feature: GYAE6OF01BEBWI.44.38.D05.1.454.CMB.1.raw
  modified_base (269)..(285): a, c, t, g, unknown or other
  misc_feature (269)..(285): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtccttccccctggccgccctgctccaggagcacctcgtggggcacgcgcggcctgggctcgccgtggtcaacggactacttcctatactactgtcgtagacggcgggctggacgaaggcgcgatgnnnnnnnnnnnnnnnnn

SEQ ID NO: 152266 - DNA, 353 bp, Homo sapiens
  misc_feature: GYAE6OF01CFESB.44.38.D05.1.454.CMB.1.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (295)..(353): a, c, t, g, unknown or other
  misc_feature (295)..(353): n is a, c, g, or t
tcagacagtatatacacgaccggtgctcgatttagtatctgatagttgggtttggggagttgcatactactactacggtatggacgtctggggccaagggccacggtcaccgtctcctcagccttccaccaaggcccatcggtcttccccctggccgccctgcctaccaggacgcacctcggtgggggccacacggccgggtcccctggggcctggcccgtagggtcaaaggccttacctcctaatactactgtctggacgggccgggntggacaacgggcgataagtgcnagcnnnnnnnnnnnnnnnnnnnnnnnnnnnnnnnnnnnnnnnnnnnnnnnnnnnnnnnnnnn

SEQ ID NO: 152267 - DNA, 629 bp, Homo sapiens
  misc_feature: GYAE6OF01CAIPT.44.38.D05.1.454.CMB.1.raw
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagcctccaggggaaggggctgggtgtgggtctcacgtattaatagtgatgggatagcacaagctacgcggactccgtgaaggccattcaccntcncagagacaacacaagacacgctgtatctgacaaagtgaaactagtcgtaggagacgccggaaggaccacgggtcttggttgtaactttacgtggtgacgaaaggcggtccgggtggcgggtaggttcggggattcgctaatacctactacgtacggtatcgggtacgtcggtacggggaccgaacgggaccgtaccggtccaccgtctccctacgacgtccttccgaccgacggaccctacgtccggtcccttcccccgtcggcccgccctcgccgtccgacggacgccgtaccgtcggtacgggccaccgccggccggcccggtgggccgtcggccggtcggtaccgaacgtaccgttaccttaccgtattaacgttctgtccg

SEQ ID NO: 152268 - DNA, 277 bp, Homo sapiens
  misc_feature: GYAE6OF01EYS4W.44.38.D05.1.454.CMB.1.raw
  modified_base (169)..(169): a, c, t, g, unknown or other
  misc_feature (169)..(169): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (264)..(277): a, c, t, g, unknown or other
  misc_feature (264)..(277): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttcccctggcgccctgctccaggancacctcgtgggggcacgagccggcccgtgggctcgccgtggtcgaaggacctacctccacgttctactgctgagcgggctggcgaggcncanagnnnnnnnnnnnnnn

SEQ ID NO: 152269 - DNA, 138 bp, Homo sapiens
  misc_feature: GYAE6OF02HZ82D.44.38.D05.1.454.CMB.1.raw
  modified_base (137)..(138): a, c, t, g, unknown or other
  misc_feature (137)..(138): n is a, c, g, or t
tcagacagtatatacacgaccggtgctcgatttagtatctgatagttgggtttgggcaggtggcacagcggccctgggctgcctggtcaaggactacttcctatatactgtctgagcgggctggcaaggcgcatagnn

SEQ ID NO: 152270 - DNA, 252 bp, Homo sapiens
  misc_feature: GYAE6OF02HM085.44.38.D05.1.454.CMB.1.raw
  modified_base (250)..(252): a, c, t, g, unknown or other
  misc_feature (250)..(252): n is a, c, g, or t
tcagacagtatatacacgaccggtgctcgatttagtatctgatagttggttgggagttgcatactactactacggtatggacgtctgggccaagggaccacggtcaccgtctcctcagcttccaccaagggcccatcggtcttccctggcgccctgctccaggagcacctctggggcacagcggccctgggctgcctggtcaaggactacttcctatatactgtctgagcgggctggcaaggcgcatagnnn

SEQ ID NO: 152271 - DNA, 255 bp, Homo sapiens
  misc_feature: GYAE6OF02IFT1Y.44.38.D05.1.454.CMB.1.raw
  modified_base (253)..(255): a, c, t, g, unknown or other
  misc_feature (253)..(255): n is a, c, g, or t
tcagacagtatatacacgaccggtgctcgatttagtatctgatagttgggtttgggagttgcatactactactacggtatggacgtctgggccaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnn

SEQ ID NO: 152272 - DNA, 198 bp, Homo sapiens
  misc_feature: GYAE6OF02GFQIV.44.38.D05.1.454.CMB.1.raw
  modified_base (191)..(198): a, c, t, g, unknown or other
  misc_feature (191)..(198): n is a, c, g, or t
tcagacagtatatacacgaccggtgctcgatttagtatctgatagttgggtttgggatagtagtagtgatcatcgggtgttcggcggagggaccaagctgaccgtcctaggtcagcccaaggctgcccctcggtcactctgttcccgccctcctctatatactgtctgagcgggctggcaaggcgcatagnnnnnnnn

SEQ ID NO: 152273 - DNA, 312 bp, Homo sapiens
  misc_feature: GYAE6OF02IWIV8.44.38.D05.1.454.CMB.1.raw
  modified_base (308)..(312): a, c, t, g, unknown or other
  misc_feature (308)..(312): n is a, c, g, or t
tcagacagtatatacacgaccggtgctcgatttagtatctgatagttgggtttgggcaccgaggacacggctgtgtattactgtacaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactactcctatatactgtctgagcgggctggcaaggcgcatagnnnnn

SEQ ID NO: 152274 - DNA, 161 bp, Homo sapiens
  misc_feature: GYAE6OF02H9WNN.44.38.D05.1.454.CMB.1.raw
  modified_base (159)..(161): a, c, t, g, unknown or other
  misc_feature (159)..(161): n is a, c, g, or t
tcagacagtatatacacgaccggtgctcgatttagtatctgatagttgggtttggggaggtgtgtcacaagatttgggctctgggcacagcggccctgggctgcctggtcaaggactacttcctatatactgtctgagcgggctggcaaggcgcatagnnn

SEQ ID NO: 152275 - DNA, 188 bp, Homo sapiens
  misc_feature: GYAE6OF02H5BLT.44.38.D05.1.454.CMB.1.raw
tcagacagtatatacacgaccggtgctcgatttagtatctgatagttgggttggatagtagtagtgatcatcgggtgttcggcggagggaccaagctgaccgtcctaggtcagcccaaggctgcccctcggtcactctgttcccaccctcctctatatactgtctgagcgggctggcaaggcgcatag

SEQ ID NO: 152276 - DNA, 256 bp, Homo sapiens
  misc_feature: GYAE6OF02HGGVI.44.38.D05.1.454.CMB.1.raw
  modified_base (254)..(256): a, c, t, g, unknown or other
  misc_feature (254)..(256): n is a, c, g, or t
tcagacagtatatacacgaccggtgctcgatttagtatctgatagttgggtttgggagttgcatactactactacggtatggacgtctgggccaagggaccacggtcaccgtctcctcagcttccaccaagggcccatcggtcttcccctggcgccctgctccaggagcacctccgagagcacagcggccctgggctgcctggtcaaggactacttcctatatactgtctgagcgggctggcaaggcgcatagnnn

SEQ ID NO: 152277 - DNA, 315 bp, Homo sapiens
  misc_feature: GYAE6OF02G780B.44.38.D05.1.454.CMB.1.raw
  modified_base (273)..(315): a, c, t, g, unknown or other
  misc_feature (273)..(315): n is a, c, g, or t
tcagacagtatatacacgaccggtgctcgatttagtatctgatagttgggtttgggagttgccatactactactacggtatggacgttctgggccaagggaccacggtcaccgtctcctcagcttccaccaagggcccatcgggtctttcccccgtggcgccctggtccttccaggagctaacctcgtggggcacagcggccctgggctagcctggtcaaggacggtacgttcctatactactcgtcgtgagcgggctggcaaggcgcatagnnnnnnnnnnnnnnnnnnnnnnnnnnnnnnnnnnnnnnnnnnn

SEQ ID NO: 152278 - DNA, 255 bp, Homo sapiens
  misc_feature: GYAE6OF02GKH4M.44.38.D05.1.454.CMB.1.raw
  modified_base (253)..(255): a, c, t, g, unknown or other
  misc_feature (253)..(255): n is a, c, g, or t
tcagacagtatatacacgaccggtgctcgatttagtatctgatagttgggtttgggacagacttcactctcagcatcagcggactggagcctgaggattctgcagtttattactgtcagcagtatggttggtcacctctgacgttcggccaagggaccaaggtggaaatcaaacgaactgtgactgcaccatctgtcttcatcttcccgccatctgatatatactgtctgagcgggctggcaaggcgcatagnnn

SEQ ID NO: 152279 - DNA, 316 bp, Homo sapiens
  misc_feature: GYAE6OF02IXXJI.44.38.D05.1.454.CMB.1.raw
  modified_base (309)..(316): a, c, t, g, unknown or other
  misc_feature (309)..(316): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnnnnnn

SEQ ID NO: 152280 - DNA, 258 bp, Homo sapiens
  misc_feature: GYAE6OF02I6A25.44.38.D05.1.454.CMB.1.raw
  modified_base (254)..(258): a, c, t, g, unknown or other
  misc_feature (254)..(258): n is a, c, g, or t
tcagacagtatatacacgaccggtgctcgatttagtatctgatagttgggtttgggagttgcatactactactacggtatggacgtctgggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnn

SEQ ID NO: 152281 - DNA, 240 bp, Homo sapiens
  misc_feature: GYAE6OF02FTQ5L.44.38.D05.1.454.CMB.1.raw
  modified_base (201)..(204): a, c, t, g, unknown or other
  misc_feature (201)..(204): n is a, c, g, or t
  modified_base (206)..(240): a, c, t, g, unknown or other
  misc_feature (206)..(240): n is a, c, g, or t
tcagacagtatatacacgaccggtgctcgatttagtatctgatagttgggtttggggatagtagtagtgatcatcgggtgttacggcggtagggaccaacgctgaccgtcctaggtcagcccaaggctgccccctcggtcactctgttcccaccctcctcgtatattactgtctgaagcgggctggccaaggcgcgatagnnnngnnnnnnnnnnnnnnnnnnnnnnnnnnnnnnnnnnn

SEQ ID NO: 152282 - DNA, 255 bp, Homo sapiens
  misc_feature: GYAE6OF02FUXEY.44.38.D05.1.454.CMB.1.raw
  modified_base (253)..(255): a, c, t, g, unknown or other
  misc_feature (253)..(255): n is a, c, g, or t
tcagacagtatatacacgaccggtgctcgatttagtatctgatagttgggtttgggagttgcatactactactacggtatggacgtctgggccaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 152283 - DNA, 261 bp, Homo sapiens
  misc_feature: GYAE6OF02ILB29.44.38.D05.1.454.CMB.1.raw
  modified_base (256)..(261): a, c, t, g, unknown or other
  misc_feature (256)..(261): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnn

SEQ ID NO: 152284 - DNA, 281 bp, Homo sapiens
  misc_feature: GYAE6OF02IW6UL.44.38.D05.1.454.CMB.1.raw
  modified_base (258)..(281): a, c, t, g, unknown or other
  misc_feature (258)..(281): n is a, c, g, or t
tcagacagtatatacacgaccggtgctcgatttagtatctgatagttgggtttggggagttgcatactactactacggtatggacgtctggggccaagggaccacggtcaccgtctcctcagcctccaccaagggcccatcggtcttccccctggccgccctgctccaggagcacctccgagagcacagcggccctgggctgcctggtcaaggactacttccacgtctactgctgagcgggctggcaaggcgcatagnnnnnnnnnnnnnnnnnnnnnnnn

SEQ ID NO: 152285 - DNA, 254 bp, Homo sapiens
  misc_feature: GYAE6OF02HGZUB.44.38.D05.1.454.CMB.1.raw
  modified_base (254)..(254): a, c, t, g, unknown or other
  misc_feature (254)..(254): n is a, c, g, or t
tcagacagtatatacacgaccggtgctcgatttagtatctgatagttgggtttgggagttgcatactactactacggtatggacgtctgggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagn

SEQ ID NO: 152286 - DNA, 165 bp, Homo sapiens
  misc_feature: GYAE6OF02JCUGR.44.38.D05.1.454.CMB.1.raw
  modified_base (159)..(165): a, c, t, g, unknown or other
  misc_feature (159)..(165): n is a, c, g, or t
tcagacagtatatacacgaccggtgctcgatttagtatctgatagttgggtttggggaggtgtgtcacaagatttgggctctgggcacagcggccctgggctgcctggtcaaggactacttccacgtctactgctgagcgggctggcaaggcgcatagnnnnnnn

SEQ ID NO: 152287 - DNA, 259 bp, Homo sapiens
  misc_feature: GYAE6OF02IKN51.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttggggtttgggagttgcatactactactacggtatggacgtctgggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnn

SEQ ID NO: 152288 - DNA, 256 bp, Homo sapiens
  misc_feature: GYAE6OF02G6883.44.38.D05.1.454.CMB.1.raw
  modified_base (254)..(256): a, c, t, g, unknown or other
  misc_feature (254)..(256): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttcccctggcgccctgctccaggagcacctctgggggcacagtggccctgggctgcctggtcaaggactacttcctatatactgtcgagcgggctggcaaggcgcatagnnn

SEQ ID NO: 152289 - DNA, 521 bp, Homo sapiens
  misc_feature: GYAE6OF02HEU1S.44.38.D05.1.454.CMB.1.raw
  modified_base (459)..(459): a, c, t, g, unknown or other
  misc_feature (459)..(459): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgcctccaggngcacctctggggcacagcggccctgggctgcctggtcaaggactacttccacgtctactgcg

SEQ ID NO: 152290 - DNA, 259 bp, Homo sapiens
  misc_feature: GYAE6OF02G4JX2.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagnnnn

SEQ ID NO: 152291 - DNA, 326 bp, Homo sapiens
  misc_feature: GYAE6OF02FQU0D.44.38.D05.1.454.CMB.1.raw
  modified_base (311)..(326): a, c, t, g, unknown or other
  misc_feature (311)..(326): n is a, c, g, or t
tcagacagtatatacacgaccggtgctcgatttagtatctgatagttgggtttgggcaccgaggacacggctgtgtattactgtgcaagagccggtagcgggagttcggggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggccgcgatagnnnnnnnnnnnnnnnn

SEQ ID NO: 152292 - DNA, 368 bp, Homo sapiens
  misc_feature: GYAE6OF02F9RUI.44.38.D05.1.454.CMB.1.raw
  modified_base (328)..(328): a, c, t, g, unknown or other
  misc_feature (328)..(328): n is a, c, g, or t
  modified_base (330)..(368): a, c, t, g, unknown or other
  misc_feature (330)..(368): n is a, c, g, or t
tcagacagtatatacacgaccggtgctcgatttagtatctgatagttggggtttcgggacaccgacggacacgggctgtcgtattactgtgcaagagccggtgcgggagttcggggagttgcgatactactacttacggtatggacgtctggggccaaagggaccacggtccaccgtctccgtcagcttccaccaagggcccatcggtcttccccctggcgccctgctcccagggacgcacctcgtgggggcacagcggcctgggctgcctggtcaaggactacttccacgtctacgtgctgagccgggctggcaaggtcgcagtagngnnnnnnnnnnnnnnnnnnnnnnnnnnnnnnnnnnnnnnn

SEQ ID NO: 152293 - DNA, 262 bp, Homo sapiens
  misc_feature: GYAE6OF02HLKAJ.44.38.D05.1.454.CMB.1.raw
  modified_base (256)..(262): a, c, t, g, unknown or other
  misc_feature (256)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccatatactgtctgagcgggctggcaaggcgcatagnnnnnnn

SEQ ID NO: 152294 - DNA, 260 bp, Homo sapiens
  misc_feature: GYAE6OF02I16RJ.44.38.D05.1.454.CMB.1.raw
  modified_base (256)..(260): a, c, t, g, unknown or other
  misc_feature (256)..(260): n is a, c, g, or t
tcagacagtatatacacgaccggtgctcgatttagtatctgatagttggggtttggcgagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnnn

SEQ ID NO: 152295 - DNA, 260 bp, Homo sapiens; identical to SEQ ID NO: 152156
  misc_feature: GYAE6OF02GJEMZ.44.38.D05.1.454.CMB.1.raw
  modified_base (257)..(260): a, c, t, g, unknown or other
  misc_feature (257)..(260): n is a, c, g, or t

SEQ ID NO: 152296 - DNA, 307 bp, Homo sapiens
  misc_feature: GYAE6OF02HAQSY.44.38.D05.1.454.CMB.1.raw
  modified_base (267)..(307): a, c, t, g, unknown or other
  misc_feature (267)..(307): n is a, c, g, or t
tcagacagtatatacacgaccggtgctcgatttagtatctgatagttgggtttgggagttgcatactactactacggtatggacgtctggggccaagggaccacggtcaaccgtctcctcagccttccaccaagggcccatcggtcttccccctggcgccctggctccacggagcacctctgggggcacaggcggcccgtgggctgccgtggtacaaggtactacttcctccgatccgcgtctgagcgggctggcaaggcgcatagnnnnnnnnnnnnnnnnnnnnnnnnnnnnnnnnnnnnnnnnn

SEQ ID NO: 152297 - DNA, 257 bp, Homo sapiens
  misc_feature: GYAE6OF02G65RO.44.38.D05.1.454.CMB.1.raw
  modified_base (256)..(257): a, c, t, g, unknown or other
  misc_feature (256)..(257): n is a, c, g, or t
tcagacagtatatacacgaccggtgctcgatttagtatctgatagttgggtttgggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnn

SEQ ID NO: 152298 - DNA, 260 bp, Homo sapiens; identical to SEQ ID NO: 152099
  misc_feature: GYAE6OF02JEUPF.44.38.D05.1.454.CMB.1.raw
  modified_base (257)..(260): a, c, t, g, unknown or other
  misc_feature (257)..(260): n is a, c, g, or t

SEQ ID NO: 152299 - DNA, 139 bp, Homo sapiens
  misc_feature: GYAE6OF02F7645.44.38.D05.1.454.CMB.1.raw
  modified_base (139)..(139): a, c, t, g, unknown or other
  misc_feature (139)..(139): n is a, c, g, or t
tcagacagtatatacacgaccggtgctcgatttagtatctgatagttgggtttggggcaggtgggcacagcggccctgggctgcctggtcaaggactacttcctatatactgtctgagcgggctggcaaggcgcatagn

SEQ ID NO: 152300 - DNA, 215 bp, Homo sapiens
  misc_feature: GYAE6OF02HOOSU.44.38.D05.1.454.CMB.1.raw
  modified_base (192)..(215): a, c, t, g, unknown or other
  misc_feature (192)..(215): n is a, c, g, or t
tcagacagtatatacacgaccggtgctcgatttagtatctgatagttgggtttgggatagtagtagtgatcatcgggtgttcggcggaggaccaagctgaccgtcctaggtccagcccaaggctgccccctcggtcactctgttcccaccctcctctatatactgtctgagcgggctggcaaggcgcatagnnnnnnnnnnnnnnnnnnnnnnnn

SEQ ID NO: 152301 - DNA, 591 bp, Homo sapiens
  misc_feature: GYAE6OF02GTEIU.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaacaccgatgggactatcactggttactcagacgccgtgaagggccgattcatcatctccagagacaatgtacgaaaacacggtgtatttacaaaatgaacagtctaagagtcgaggacacggctgtctactattgtgtgagaccttatgatttcacgtttgggggatttatcggtttgggcccacgacgtgggggcccaaggggaaccctttgggtcgttcgtctcctcagcttccaccaacgggcccatccggtccttcccccgtcggccgtccctcgcctccacgggacgccaccgtcgtcgggggccacgacgccggcccgtgggcctcggcccgttgggtccaagggtacctaccgttcctaatacttactcgtcgtggacggccgggctcggcgaaggcg

SEQ ID NO: 152302 - DNA, 259 bp, Homo sapiens
  misc_feature: GYAE6OF02HTY6Y.44.38.D05.1.454.CMB.1.raw
  modified_base (256)..(259): a, c, t, g, unknown or other
  misc_feature (256)..(259): n is a, c, g, or t
tcagacagtatatacacgaccggtgctcgatttagtatctgatagttgggtttggggagttgcatactactactacggtatggacgtctggggccaagggaccacggtcaccgtctcctcagcctccaccaagggcccatcggtcttcccctggcgccctgctccatgagcacctctgggggcacagcggccctgggctgcctggtcaaggactacttcctatatactgtctgagcgggctggcaaggcgcatagnnnn

SEQ ID NO: 152303 - DNA, 258 bp, Homo sapiens
  misc_feature: GYAE6OF02GT23H.44.38.D05.1.454.CMB.1.raw
  modified_base (257)..(258): a, c, t, g, unknown or other
  misc_feature (257)..(258): n is a, c, g, or t
tcagacagtatatacacgaccggtgctcgatttagtatctgatagttgggtttggggagttgcatactactactacggtatggacctctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnn

SEQ ID NO: 152304 - DNA, 193 bp, Homo sapiens; identical to SEQ ID NO: 152076
  misc_feature: GYAE6OF02G3JCC.44.38.D05.1.454.CMB.1.raw
  modified_base (192)..(193): a, c, t, g, unknown or other
  misc_feature (192)..(193): n is a, c, g, or t

SEQ ID NO: 152305 - DNA, 559 bp, Homo sapiens
  misc_feature: GYAE6OF02GZ9O6.44.38.D05.1.454.CMB.1.raw
tcagacagtatatacacgaccggtgctcgatttagtatctgatagtggagtccggggaggcttagttcagcctgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtcgtggggccaagggaccacggtcaccgtctcctcagcttccaccgaacggcccatcgtccttccccgtcggccgccctcgcctccgacggacgccaccgtcgtcggggccaccgacggccggcccgtcgggcctcggcccgtcggtaccgaaggaccttaccgttcccttactacttaccgtgtcg

SEQ ID NO: 152306 - DNA, 264 bp, Homo sapiens
  misc_feature: GYAE6OF02JBX2U.44.38.D05.1.454.CMB.1.raw
  modified_base (256)..(264): a, c, t, g, unknown or other
  misc_feature (256)..(264): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnn

SEQ ID NO: 152307 - DNA, 314 bp, Homo sapiens
  misc_feature: GYAE6OF02GV9MS.44.38.D05.1.454.CMB.1.raw
  modified_base (310)..(314): a, c, t, g, unknown or other
  misc_feature (310)..(314): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnn

SEQ ID NO: 152308 - DNA, 561 bp, Homo sapiens
  misc_feature: GYAE6OF02IS2HZ.44.38.D05.1.454.CMB.1.raw
  modified_base (383)..(383): a, c, t, g, unknown or other
  misc_feature (383)..(383): n is a, c, g, or t
tcagacagtatatacacgaccggtgctcgatttagtatctgatagttgggtttgggggaagaggaagactgacggtcctcccaggagttcaggtgctgggcaccttgggcacggggaggcttagttcagcctggggggtccctgagactctcctgtgcagcctctggattcaccttcagtagctactggatgcactgggtccgccaagctccagggaaggggctgggtgtgggtctcacgtattaatagtgatgggagtagcacaagctacgcggactccgtgaaggccgatcacatctcagagacaacgccaagaacacgctgtatctgcaaatgaaacagtctgagagccgaggacacggctgtgtattactgtgacaagngccggtggcgggtaggttcggggagttgcatactactactacggtatggacgtcgtggggacaacgggacgacggtcaccgtctcctcacgtcttccaccgaacggcccacgtccggtccgttcccccgtcggccgtcccgtcgcctcccgacggacgccgacccgtcgtcggggccg

SEQ ID NO: 152309 - DNA, 320 bp, Homo sapiens
  misc_feature: GYAE6OF02GZE22.44.38.D05.1.454.CMB.1.raw
  modified_base (310)..(320): a, c, t, g, unknown or other
  misc_feature (310)..(320): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnnnn

SEQ ID NO: 152310 - DNA, 261 bp, Homo sapiens; identical to SEQ ID NO: 152144
  misc_feature: GYAE6OF02HP5PC.44.38.D05.1.454.CMB.1.raw
  modified_base (258)..(261): a, c, t, g, unknown or other
  misc_feature (258)..(261): n is a, c, g, or t

SEQ ID NO: 152311 - DNA, 567 bp, Homo sapiens
  misc_feature: GYAE6OF02HSHUE.44.38.D05.1.454.CMB.1.raw
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatgggacgtcgtcgggccgaagggaccacggtcaccgtcctcctcacgtccttaccaccaacgggcccacgtccggtccgttcccccgtcggccgtccccgtcgccgtcccgacggacgccgtaccctcggtggggtccg

SEQ ID NO: 152312 - DNA, 259 bp, Homo sapiens; identical to SEQ ID NO: 152102
  misc_feature: GYAE6OF02GQ6XZ.44.38.D05.1.454.CMB.1.raw
  modified_base (257)..(259): a, c, t, g, unknown or other
  misc_feature (257)..(259): n is a, c, g, or t

SEQ ID NO: 152313 - DNA, 260 bp, Homo sapiens
  misc_feature: GYAE6OF02JBHRB.44.38.D05.1.454.CMB.1.raw
  modified_base (258)..(260): a, c, t, g, unknown or other
  misc_feature (258)..(260): n is a, c, g, or t
tcagacagtatatacacgaccggtgctcgatttagtatctgatagttggggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnn

SEQ ID NO: 152314 - DNA, 258 bp, Homo sapiens
  misc_feature: GYAE6OF02FFWAQ.44.38.D05.1.454.CMB.1.raw
  modified_base (257)..(258): a, c, t, g, unknown or other
  misc_feature (257)..(258): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnn

SEQ ID NO: 152315 - DNA, 518 bp, Homo sapiens
  misc_feature: GYAE6OF02F4W1T.44.38.D05.1.454.CMB.1.raw
  modified_base (407)..(407): a, c, t, g, unknown or other
  misc_feature (407)..(407): n is a, c, g, or t
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggcctcagggatccctgagcgattctctggctccaactctgggaacacggccaccctgaccatcagcagggtcgaagccggggatgaggccgatatacngtcaggtgtgggatagtagtagtgatcgatcgggtgttcgggcggagggaccaagctgaccgtctaggtcagcccgaaggctcgcccctcggtccactctcgtccctaccc

SEQ ID NO: 152316 - DNA, 254 bp, Homo sapiens
  misc_feature: GYAE6OF02H23JJ.44.38.D05.1.454.CMB.1.raw
  modified_base (252)..(254): a, c, t, g, unknown or other
  misc_feature (252)..(254): n is a, c, g, or t
tcagacagtatatacacgaccggtgctcgatttagtatctgatagttgggtttgggacagacttcactctcagcatcagcagactggagcctgaagattttgcagtgtattactgtcagcagtatgcttactcacctctgacgttcggccaagggaccaaggtggaaatcaaacgaactgtggctgcaccatctgtcttcatcttccgccatctgatatatactgtctgagcgggctggcaaggcgcatagnnn

SEQ ID NO: 152317 - DNA, 256 bp, Homo sapiens
  misc_feature: GYAE6OF02IU4XO.44.38.D05.1.454.CMB.1.raw
  modified_base (252)..(256): a, c, t, g, unknown or other
  misc_feature (252)..(256): n is a, c, g, or t
tcagacagtatatacacgaccggtgctcgatttagtatctgatagttgggtttgggtagttgcatactactactacggtatggacgtctgggccaagggaccacggtcaccgtctcctcagcttccaccaaggcccatcggtcttcccctggcgccctgctccaggagcacctctggggcacagcggccctgggctgcctggtcaaggactacttccacgtctactgctgagcgggctggcaaggcgcatgnnnnn

SEQ ID NO: 152318 - DNA, 579 bp, Homo sapiens
  misc_feature: GYAE6OF02GITJ1.44.38.D05.1.454.CMB.1.raw
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattacngtgcaagngcggtgcgggagtcgggagtgcatactactactacggtagtggacgtcgtggggccgaacgggaccgacggtccaccgtccgtcctcgtacgccttccgaaccgaaccgggacccacgttccggtccgttcccccgtcggtcccgtcccgtcgtccgtcccgacggaccgccgtacccgtccgtcggggtaccg

SEQ ID NO: 152319 - DNA, 536 bp, Homo sapiens
  misc_feature: GYAE6OF02ISN3E.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaaatagtgatgggagtagcacaagctacgcggactccgtgagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtcgtggggccaagggaccacggtcaccgtctcctcacgcttccaccgaacgggccatcggtccttccccgtggccgccctgcctccaggcgcacctcgtcgggcacgacgcggccgtgggctcgccgtggtcgaaggtactacgttcctatactactgtcg

SEQ ID NO: 152320 - DNA, 259 bp, Homo sapiens; identical to SEQ ID NO: 152102
  misc_feature: GYAE6OF02FQJTU.44.38.D05.1.454.CMB.1.raw
  modified_base (257)..(259): a, c, t, g, unknown or other
  misc_feature (257)..(259): n is a, c, g, or t

SEQ ID NO: 152321 - DNA, 352 bp, Homo sapiens
  misc_feature: GYAE6OF02H24VF.44.38.D05.1.454.CMB.1.raw
  modified_base (336)..(352): a, c, t, g, unknown or other
  misc_feature (336)..(352): n is a, c, g, or t
tcagacagtatatacacgaccggtgctcgatttagtatctgatagttgggtttgggtcaccgaggacacggctgtgtattactgtgcaagagccggtgcgggagttcgggagttggcgatactactactacggtatggacgtctgggccaagggaccacggtcaccgtctcctcacgcttccaccaaggcccatcggtcttccccctggccgccctgcctccacggacgccaccctcgtcggggcacgacggccggcccctggggcctgcccgtggtaccgaaggacctacttcctatactactgtctgagcgggtactggcaaggcgacagtagnnnnnnnnnnnnnnnnn

SEQ ID NO: 152322 - DNA, 319 bp, Homo sapiens
  misc_feature: GYAE6OF02HYX84.44.38.D05.1.454.CMB.1.raw
  modified_base (311)..(319): a, c, t, g, unknown or other
  misc_feature (311)..(319): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggcccctgggctgcctggtcaaggactacttccacgtctactgctgagcgggctggcaaggcgcatagnnnnnnnnn

SEQ ID NO: 152323 - DNA, 642 bp, Homo sapiens
  misc_feature: GYAE6OF02IAQ4B.44.38.D05.1.454.CMB.1.raw
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagctccagggaaggggctggtgtgggtctcacgtattaatagtgatgggatagcacaagctacgcggactccgtgaagggccattcacatctcagagacaacgccaagaacacgctgtatctgcaaatgaacagtctgagagccgaggacacggctgngtatactgtncaagagccggtgcggagttcggggatgcatactactactacggtatggacgtcgtggggccaacgggacccacggtccaaccggtcttcctcgacgtccttaccacccgaaacgggcccctaagttccgggttaccctttccccccgtgggacccgtcccccgttagccccgttccgaacgttcggaacgccgtaaccccgtccggttacgggggaccaaccggaccggcccgggtaccccggtggggtcccttacggccccggttacgggtaccgtaaacgggtacccttaacccgtttacccgaccggtttacctacgttcgg

SEQ ID NO: 152324 - DNA, 159 bp, Homo sapiens
  misc_feature: GYAE6OF02FU2VK.44.38.D05.1.454.CMB.1.raw
  modified_base (159)..(159): a, c, t, g, unknown or other
  misc_feature (159)..(159): n is a, c, g, or t
tcagacagtatatacacgaccggtgctcgatttagtatctgatagttgggtttgggggaggtgtgtcacaagatttgggctctgggcacagcggccctgggctgcctggtcaaggactacttcctatatacttctgagcgggctggcaaggcgcatagn

SEQ ID NO: 152325 - DNA, 260 bp, Homo sapiens
  misc_feature: GYAE6OF02H70ID.44.38.D05.1.454.CMB.1.raw
  modified_base (256)..(260): a, c, t, g, unknown or other
  misc_feature (256)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnn

SEQ ID NO: 152326 - DNA, 259 bp, Homo sapiens
  misc_feature: GYAE6OF02F4JGP.44.38.D05.1.454.CMB.1.raw
  modified_base (259)..(259): a, c, t, g, unknown or other
  misc_feature (259)..(259): n is a, c, g, or t
tcagacagtatatacacgaccggtgctcgatttagtatctgatagttgggtttgggggagttgcatactactactacggtatggacgtcgtggggccgaagggaccacggtcaccgtctcctcagcttccaccaaggccatcggtcttcccctggcgccctgctccaggagcacctcgtgggggcacagcggcccgtgggctgcctggtcaaggactacttcctatatactgtctgagcgggctggcaaggcgcatagn

SEQ ID NO: 152327 - DNA, 315 bp, Homo sapiens
  misc_feature: GYAE6OF02IICCX.44.38.D05.1.454.CMB.1.raw
  modified_base (308)..(315): a, c, t, g, unknown or other
  misc_feature (308)..(315): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactatctgagcggctggcaaggcgcatagnnnnnnnn

SEQ ID NO: 152328 - DNA, 726 bp, Homo sapiens
  misc_feature: GYAE6OF02GBMLA.44.38.D05.1.454.CMB.1.raw
  modified_base (133)..(133): a, c, t, g, unknown or other
  misc_feature (133)..(133): n is a, c, g, or t
tcagacagtatatacacgaccggtgctcgatttagtatctgatagtgggagtccgggggaggccttagttcagcctagggggtcccgtggagtacctcttccgtgtgcagcctctggattcaccttcgagtancctactggattggcactgggtccgcgttaacgcgttccagggtaagggttactggttgtcggtctcgacgtaatttaatacgtagagttggggaagttacgcggggactaaggcctaacggccggtacggtaccggttcgaaaggggcccgaatttccaccctatccgtcccaaggacgtacaaacggcctaaagaacctacgactagtaagtcttgccaaaattggaaaccacgtacgtgacgaaggcccgaagggacctacgggacgttggtcgttaggttacctaggtttggtaccaaaggtacgtcgggtaaggacgggtaggtttccggggaaattacgactaataactaacctacgtacgggaagtcggaacgttcctacggggacctaacgggtacccagggtacaacccgtactcccgtacgaacgccttacccaccgtaaagggtcccctagtccggtaacctttccccgagccgccctaggccttccgaggagccgactcgttagggtcacgtagacggccggtaggtactagcgtcgtacgaacgtacctaacgttaccttaagttacgtaccgtgtaccgg

SEQ ID NO: 152329 - DNA, 317 bp, Homo sapiens
  misc_feature: GYAE6OF02F8U8Z.44.38.D05.1.454.CMB.1.raw
  modified_base (271)..(317): a, c, t, g, unknown or other
  misc_feature (271)..(317): n is a, c, g, or t
tcagacagtatatacacgaccggtgctcgatttagtatctgatagttgggtttggggagttgcatacctactactacggtatggacgtctggggtccaagggaccacggtcaccgtctcctcagcttccaccaagggcccatcggtcttccccctgggcgccctgctcctaggagcacctcttagggggcacagcggccctggggctgcctggtcaagggactacttccgtatatacgtgtctgaggccgggctggcaacggccgcatagnnnnnnnnnnnnnnnnnnnnnnnnnnnnnnnnnnnnnnnnnnnnnnn

SEQ ID NO: 152330 - DNA, 570 bp, Homo sapiens
  misc_feature: GYAE6OF02I31OR.44.38.D05.1.454.CMB.1.raw
  modified_base (169)..(169): a, c, t, g, unknown or other
  misc_feature (169)..(169): n is a, c, g, or t
  modified_base (208)..(208): a, c, t, g, unknown or other
  misc_feature (208)..(208): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctggagacgtctccgtggtgcagcctntggattcaccttcagtagctactggatgcactgggtccnccaagctccaggggaaggggctgggtgtgggtctcacgtattaatagtgattgggagtagcacgaagctacgcggactccgtgaagggccattcaccatctccagagacaacgccaagaaccncgtctgtanctgacaaatgaaaacngtctagagagccgaggactacgggctgtntattactgngcaagngcggtgcgggaggttcgggagttgcatactactactacggtatggacgtcgtgggccgaagggccacggtcgaccgtcgtcctcgagccgtcaccgacgggcccacgtaccgtccgttccccgtggcccgtcccgtcgtcctccgaggacgccgaaccgtccgtggggcc

SEQ ID NO: 152331 - DNA, 290 bp, Homo sapiens
  misc_feature: GYAE6OF02G434M.44.38.D05.1.454.CMB.1.raw
  modified_base (141)..(141): a, c, t, g, unknown or other
  misc_feature (141)..(141): n is a, c, g, or t
  modified_base (229)..(238): a, c, t, g, unknown or other
  misc_feature (229)..(238): n is a, c, g, or t
  modified_base (240)..(290): a, c, t, g, unknown or other
  misc_feature (240)..(290): n is a, c, g, or t
tcagacagtatatacacgaccggtgctcgatttagtatctgatagttgggtttagggggccgaagggaccacggtcaccgtctcctcgagcttccaccaagggcccatcggtcttccccctggcgccctcgcctccaggancacctctgggggcacagcggccctgggctgcctggtcaaggactacttcctatactactgtctgagccgggctggcaaggcgcatagnnnnnnnnnnannnnnnnnnnnnnnnnnnnnnnnnnnnnnnnnnnnnnnnnnnnnnnnnnnn

SEQ ID NO: 152332 - DNA, 312 bp, Homo sapiens
  misc_feature: GYAE6OF02FTZ8O.44.38.D05.1.454.CMB.1.raw
  modified_base (309)..(312): a, c, t, g, unknown or other
  misc_feature (309)..(312): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnn

SEQ ID NO: 152333 - DNA, 585 bp, Homo sapiens
  misc_feature: GYAE6OF02GW9MB.44.38.D05.1.454.CMB.1.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgagtgggagtagcacaagctacgcggactccgtgaagggccattcaccatctccagagacaacgccaagaacacnctgtatctgacaaatgaacngtctgagacgcgaggaccacggctgtntattacngtgcaagngccggtggcggagttcggggattcgctagtactactacgtacggtatcggacgtcgtaggggaccgaagggaccctacggtcctaccgtcctcctcacgtcctccgaccgacgggccctagtccgtcccttccccgtcggaccgtcccgtgccgtccgacggacgcctaccgtcggtcgggcctacgacggtccggcccgtcgggcctcggccgtggtaccgaacggtaccttacgttcctactacgtactgtacg

SEQ ID NO: 152334 - DNA, 337 bp, Homo sapiens
  misc_feature: GYAE6OF02JW85M.44.38.D05.1.454.CMB.1.raw
  modified_base (277)..(277): a, c, t, g, unknown or other
  misc_feature (277)..(277): n is a, c, g, or t
  modified_base (280)..(281): a, c, t, g, unknown or other
  misc_feature (280)..(281): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (289)..(337): a, c, t, g, unknown or other
  misc_feature (289)..(337): n is a, c, g, or t
tcagacagtatatacacgaccggtgctcgatttagtatctgatagttgggtttggggagttgcactactactactacggtactggacgtctggggccaagggaccacggtcaccgtctccgtccaggcttccacccaagggtcccatcggtcttccccctggcgcccctgctccaggagccaccgtctgggggcacagcgccctgggctcgcctggtcaaggactacttccgtactatactggtacttgagcgggcgtggtcaaggcgcacttaggncannctnantgnnnnnnnnnnnnnnnnnnnnnnnnnnnnnnnnnnnnnnnnnnnnnnnnn

SEQ ID NO: 152335 - DNA, 580 bp, Homo sapiens
  misc_feature: GYAE6OF02JHLDG.44.38.D05.1.454.CMB.1.raw
  modified_base (284)..(284): a, c, t, g, unknown or other
  misc_feature (284)..(284): n is a, c, g, or t
  modified_base (410)..(410): a, c, t, g, unknown or other
  misc_feature (410)..(410): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagaacacgctgtatctgcaaatgaacngtctgagagccgaggacacggctgtgtattactgtgcaagagccggtgcggagttcggggattgcatactactactacggtatggacgtcgtggggccgaagggaccgacggtcaccgtctcctcncgtctccaccaggcccagtcgtccttccccgtggccgtccctcgcctccgaggacgccaccgtcggtcggggccaccgacggccggtcccgtcggggtcctcggtcccgtcggtaccgaacggtacccttaaccgtttccgttaacgttaccgttaccgttcgttaccgg

SEQ ID NO: 152336 - DNA, 262 bp, Homo sapiens
  misc_feature: GYAE6OF02FK7X1.44.38.D05.1.454.CMB.1.raw
  modified_base (258)..(262): a, c, t, g, unknown or other
  misc_feature (258)..(262): n is a, c, g, or t
tcagacagtatatacacgaccggtgctcgatttagtatctgatagttggggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnn

SEQ ID NO: 152337 - DNA, 552 bp, Homo sapiens
  misc_feature: GYAE6OF02IN0O3.44.38.D05.1.454.CMB.1.raw
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacgttgggggatttagtcgttttgggccccacgacgtggggccaggggaaccttggtcgtcgtctcctcagcttccaccgaacgggcccagtccgtccttccccgtggccgccctgcctccaggcncnccgtcgtggggcacgacgcggccctgggctcgcctggtcacggtactaccgttctaatacgtactgtctgacgcggctggcgaggcg

SEQ ID NO: 152338 - DNA, 261 bp, Homo sapiens
  misc_feature: GYAE6OF02FIR6G.44.38.D05.1.454.CMB.1.raw
  modified_base (256)..(261): a, c, t, g, unknown or other
  misc_feature (256)..(261): n is a, c, g, or t
tcagacagtatatacacgaccggtgctcgatttagtatctgatagttgggtttggggagttgcatactactactacggtatggacgtctgggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 152339 - DNA, 263 bp, Homo sapiens
  misc_feature: GYAE6OF02IOF37.44.38.D05.1.454.CMB.1.raw
  modified_base (256)..(263): a, c, t, g, unknown or other
  misc_feature (256)..(263): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagnnnnnnnn

SEQ ID NO: 152340 - DNA, 561 bp, Homo sapiens
  misc_feature: GYAE6OF02HBYYM.44.38.D05.1.454.CMB.1.raw
  modified_base (340)..(340): a, c, t, g, unknown or other
  misc_feature (340)..(340): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaaggccgattcaccatctccagagacaacgccaagaacacgctgatctgcaaatgaacngtctagagagcgaggacacggctgtgtattactgtgacaagacgcggtggcgggaggttcggggagttgcatactactactacggttagtggacgtcgtgggccgaagggaccgacggtcaccgtctccgtcacgtccttccaccgacggcccacgtccggtccgttcccccgtcggccgtcccgtcgccgtccgacggacgccacccgtcgtcggggccg

SEQ ID NO: 152341 - DNA, 592 bp, Homo sapiens
  misc_feature: GYAE6OF02HO5EP.44.38.D05.1.454.CMB.1.raw
  modified_base (383)..(383): a, c, t, g, unknown or other
  misc_feature (383)..(383): n is a, c, g, or t
tcagacagtatatacacgaccggtgctcgatttagtatctgatagttgggtttgggggaagaggaagactgacggtcctcccaggagttcaggtgctgggcaccttgtgcacgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaagggccattcaccatcctccagagacaacgccaaagacacgctgtatctgacaaaatgaaacagtctgagacgccgaggacacggctgtgttaattacnggtgacaaaggaggccgggtggcggggtaggttcggggagttgctatactactacgtacggtatggtacgtcgtagggaccgaagggaccgacggtccaccgtcctcctccgacgtcctaccgaccgaacgggcccacgttccggttcccttcccccgtcggcccgtccccgtcgccctccgacggacgccgtacccgtccggtcgggg

SEQ ID NO: 152342 - DNA, 791 bp, Homo sapiens
  misc_feature: GYAE6OF02HS15A.44.38.D05.1.454.CMB.1.raw
  modified_base (252)..(252): a, c, t, g, unknown or other
  misc_feature (252)..(252): n is a, c, g, or t
tcagacagtatatacacgaccggtgctcgatttagtatctgatagtgggtaggtccgggggaggcttagttcagcctgggggggtccctgagactctcctgtgcagcctctcggattcaccttcagtagctactggatgcactgggtccgccaagctccgagggaagggctggtgtggtctcacgttattaactagtgatgggagtagcacaagctacgcggactcgtagaaggccattcacatctccaganacacgcaagaacagctgtatctgacaaatgaacagtctagagagcgaggacacggctgtgtattacgtgtgacaagacggtccgggtgacggggtaggtttccgggggagttcggacctaattaaccgttaacgttaccgttaacgggtaagtcgggtaccgttacggtacggggggaccgaaacggggtacccgtaaccgggttccgtaacccgttccttacccgttacgtacggtaccctttacccgaacccgtaaaccggggtacccctaaccggttcccgggtttacccctttcccccggtacgggtaccccgttacccggttcggtacccgttacccggtaacgggtaccgtacccgttaacccgttaccgggtacgggggtacccgtaccggtaccgggtaccccgggttacccggttaccggggtcccgttccggtaccccgggttaccggggtaacccgttaaaccgggttacccgtttaacccggttacccgttaacccggttacccgtttacccgtacgggttacccgg

SEQ ID NO: 152343 - DNA, 263 bp, Homo sapiens
  misc_feature: GYAE6OF02I21IN.44.38.D05.1.454.CMB.1.raw
  modified_base (187)..(187): a, c, t, g, unknown or other
  misc_feature (187)..(187): n is a, c, g, or t
  modified_base (253)..(263): a, c, t, g, unknown or other
  misc_feature (253)..(263): n is a, c, g, or t
tcagacagtatatacacgaccggtgctcgatttagtatctgatagttgggtttgggagttgcatactactactacggtatggacgtctgggccaagggaccacggtcaccggtctcctcacgcttccaccaagggcccatcggtcttcccctggccgccctgctccaggagcacctcgtggggcacngcgcctggctgcctggtcaggactactcctatagtactgtctgagcgggctggcaaggcgtcatgnnnnnnnnnnn

SEQ ID NO: 152344 - DNA, 559 bp, Homo sapiens
  misc_feature: GYAE6OF02F1FZ3.44.38.D05.1.454.CMB.1.raw
  modified_base (506)..(506): a, c, t, g, unknown or other
  misc_feature (506)..(506): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaacaccgatgggactatcactggttactcagacgccgtgaaggccgattcatcatctccagagacaatgtcgaaaacacggtagtatttacaaatgaacagtctaagagtcgaggacacggctgtctactattgtgtgagtaccttatgtatttcacgtttgggggtagtttagtcggtttgggccctacgacgtggggccagggtaaccttggtcgtcgtctcctcagcttccaccgaggcccatcggtcttcccctggcnccctgcctcgaggcgccacctcgtcggggcacgcgccggccgtcggctgtccg

SEQ ID NO: 152345 - DNA, 328 bp, Homo sapiens
  misc_feature: GYAE6OF02GT5HR.44.38.D05.1.454.CMB.1.raw
  modified_base (313)..(313): a, c, t, g, unknown or other
  misc_feature (313)..(313): n is a, c, g, or t
  modified_base (315)..(328): a, c, t, g, unknown or other
  misc_feature (315)..(328): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagccggccctgggctgcctggtcaaggactacttcctatatactgtctgagcgggctggcaagggcgcatagcngnnnnnnnnnnnnnn

SEQ ID NO: 152346 - DNA, 614 bp, Homo sapiens
  misc_feature: GYAE6OF02IEGAQ.44.38.D05.1.454.CMB.1.raw
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgcaagctccgagggagggctggtgtggtctcacgtattaatgtgatgggagtagcacaagctacgcggactccgagaggccattccacntcnccaganacaacgcaagaacacgctgtatcgtgacaaatcgaaacngtcngagagccgagacacgctgtntatactgnagagagtccggngcggtagtacggggattgctagtactacgtaccgtaggtagtcggtacgttcgtacggggaccgaagggtacccacggtcgacccgttcgtcctacacgccttccgaaccgtaacgggtacccacgttccggtacccttccccgccggtcccgacccttcgacccgtccgacggacgtcccgtaccgttccggtacgggcctacgaccggtcggcccggtacggtccgtccgccgttcggtaccgtaaccgtacctttacccgttacctacttacgttacgtgtaccgg

SEQ ID NO: 152347 - DNA, 261 bp, Homo sapiens
  misc_feature: GYAE6OF02IF3ZA.44.38.D05.1.454.CMB.1.raw
  modified_base (257)..(261): a, c, t, g, unknown or other
  misc_feature (257)..(261): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnn

SEQ ID NO: 152348 - DNA, 553 bp, Homo sapiens
  misc_feature: GYAE6OF02G45J3.44.38.D05.1.454.CMB.1.raw
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggatagcacaagctacgcggactccgtgaagggccgattcaccatctccagagacaacgccaagaacacgctgtatctgcaaatgaacagtctgagagccgaggacacggctgtgtattactgtgacaagagcggtgcgggagttcggggagttgcatactactactacggtatggacgtcgtgggacaagggaccgacggtcgaccgtctcctcacgcttccaccgacggcccatccggtccgttccccgtcggtccgcccgtcgccgtccgacggacgccgacctcggtggggaccg

SEQ ID NO: 152349 - DNA, 312 bp, Homo sapiens
  misc_feature: GYAE6OF02FF9BT.44.38.D05.1.454.CMB.1.raw
  modified_base (308)..(312): a, c, t, g, unknown or other
  misc_feature (308)..(312): n is a, c, g, or t
tcagacagtatatacacgaccggtgctcgatttagtatctgatagttgggtttgggcaccgaggacacggctgtgtattactgtgcaagagccggtgcgggagttcggggagttgcatactaatactacggtatggacgtctggggccaagggaccacggtcaccgtctcctcagcttccaccaagggcccatcggtcttccccctggcgccctgctccaggagcacctctgggggcacagcggccctggctgcctggtcaaggctacttcctatatactgtctgagcgggctggcaaggcgcatagnnnnn

SEQ ID NO: 152350 - DNA, 262 bp, Homo sapiens
  misc_feature: GYAE6OF02IP8Y6.44.38.D05.1.454.CMB.1.raw
  modified_base (257)..(262): a, c, t, g, unknown or other
  misc_feature (257)..(262): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnn

SEQ ID NO: 152351 - DNA, 797 bp, Homo sapiens
  misc_feature: GYAE6OF02IQNKX.44.38.D05.1.454.CMB.1.raw
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagacagtatatacacgaccggtgctcgatttagtatctgatagtggagtccgggggaggcgttagttcagcctggggggtccctggagactctcctgtgtcgcctctggattcaccatcagtgaccactatatggactgggtccgccaggctccagggagggctggagtggcttggccgcagtaaaaacaagttgccagtctttanccanagagtacgccgcgtctgtgaaagcccaaggattccaacccttcncaagngatcgacttcaagaactcattgattcctgcgtaatgaacttaaccgtagaaaacccgaggacacgggcaatgtattattgtagttgttagtttatatcgaagtaacttcgtacctaagtcgggggacctaaggggtaaccccttgggtacccaccgttaccttccccgtacgaccgtcctaccccgtaaccgtaaccgggtccccacgttcccgggttaccctttccccccgtagggtccccgttccccgttacggccccttaacccggtacgggtacccggtacccctaacccggttccccggtaaacgaccggcccgaaacccggtccgggtaccccggggtccccgttacggggggtccccttcggtaccccggtttacgggaacccggtaaccgggttaacccttaccccgttttaacccgtttaacgttaaccctttaaccggttaccggttcccgttaacggggacccgggttacccggggtcccgttacgggtaaccccgggtacgggttaccccggtacgttaacggg

SEQ ID NO: 152352 - DNA, 260 bp, Homo sapiens
  misc_feature: GYAE6OF02GBQNQ.44.38.D05.1.454.CMB.1.raw
  modified_base (257)..(260): a, c, t, g, unknown or other
  misc_feature (257)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcaccctcctccaagagcacctctgggggcacagcggccctgggctgcctggtcaaggactacttccacgtctactgctgagcgggctggcaaggcgcatagnnnn

SEQ ID NO: 152353 - DNA, 265 bp, Homo sapiens
  misc_feature: GYAE6OF02ICTKZ.44.38.D05.1.454.CMB.1.raw
  modified_base (257)..(265): a, c, t, g, unknown or other
  misc_feature (257)..(265): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnn

SEQ ID NO: 152354 - DNA, 604 bp, Homo sapiens
  misc_feature: GYAE6OF02F55WC.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggagggctggtgtgggtctcacgtattaatagtgatgggagtagcacaagctacgcggactccgtgaagggccattcaccatctccagacgacaacgccaaagaacacgctgtatctgcaaaatcgaacagtctagagagccgaggacacggctgtgtattactgtgcaagacggccgggtggcgggtaggttcgggggattgctatactactacgtacggtatgggacgtcgtggggaccgaacgggaccacggtccgaccgtctcctcacgtccttccaaccgacgggcccacgttccggtccttcccccgtcggccgtccctcgcctccgacggacgcctaccgtcgtcggggccacgacggccggcccgtcgggtccgtcgcccgttcggttaccgaacggtaccttaccgtttaccgttaacttacgttaccgtcgttaccgg

SEQ ID NO: 152355 - DNA, 328 bp, Homo sapiens
  misc_feature: GYAE6OF02GQST0.44.38.D05.1.454.CMB.1.raw
  modified_base (312)..(328): a, c, t, g, unknown or other
  misc_feature (312)..(328): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgcctccaggagcacctctgggggcacagcggcccctgggctgcctggtcaaggactactccacgtctacctgctgagcgggctggcaaggcgcatagnnnnnnnnnnnnnnnnn

SEQ ID NO: 152356 - DNA, 619 bp, Homo sapiens
  misc_feature: GYAE6OF02HZDYL.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagctccagggaagggctggtgtgggtctcacgtattaatagtgagtgggatagtacaagctacgcggactccgtgaagggccattcacatctcagagacaacgcaaagaacacgctgtatctagacaaatgaacagtctgagagccgaggacacggctgttagtattactgtgacaagcggccggtgacggggtaggttcggggattgctagtactactacgtacggtatcggacgttcgtaggggaccaacgggaccgtaccggtctacccgttctcctcgtacgtacccttacccgaaccgaacgggcccctagttacccgtccttcccccgtgcccgcccttgcctaccgacgacgctacccgtcggtcgggccacgacgcccgtccgtcgggccttcggccgttcgggacctaaacgggtcctttaaccgtttcccgtaagttaccttacgttcggttacgtacgg

SEQ ID NO: 152357 - DNA, 260 bp, Homo sapiens
  misc_feature: GYAE6OF02IU5TG.44.38.D05.1.454.CMB.1.raw
  modified_base (256)..(260): a, c, t, g, unknown or other
  misc_feature (256)..(260): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaaggcgcatagnnnnn

SEQ ID NO: 152358 - DNA, 591 bp, Homo sapiens
  misc_feature: GYAE6OF02HJRHU.44.38.D05.1.454.CMB.1.raw
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccgcaggctccgaggcgagggggctggaggtggggtggcgaggtgtgtcatttcagtggaaggaatcaagtctacggtgatttccggtgacgggccgtattcaccatctccagagacaattcgaacgaacacagtgtctcttactaaatacgaacagtaccgtagacgacctacgacggaacgaccggtccgttaggtttacgttttcgttcgtacggtaacgtactagttcgttacgtttaccgtaaacgttcggttacctacgttccgtaccgtccgtaccgggg

SEQ ID NO: 152359 - DNA, 193 bp, Homo sapiens
  misc_feature: GYAE6OF02F7BX0.44.38.D05.1.454.CMB.1.raw
  modified_base (192)..(193): a, c, t, g, unknown or other
  misc_feature (192)..(193): n is a, c, g, or t
tcagacagtatatacacgaccggtgctcgatttagtatctgatagttgggtgtgggatagtagtagtgatcatcgggtgttcggcggagggaccaagctgaccgtcctaggtcagcccaaggctgcccccctggtcactctgttcccgccctcctctatatactgtctgagcgggctggcaaggcgcatagnn

SEQ ID NO: 152360 - DNA, 746 bp, Homo sapiens
  misc_feature: GYAE6OF02FFJXK.44.38.D05.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacagtatatacacgaccggtgctcgatttagtatctgatagtggagtccggggagcttagttcagcctggggggtccctgagactctcctgtgcagcctctggattcaccttcagtagctactggatgcactggtccgccaagctccagggaagggctggtgtgggtctcacgttattaatagtgatgggagtagcanaagctacgcggactccgtgaggccattcaccntctcagagacaacgccaagacacgctgtatctagacaaatgaacagtctgagagccgaggaccacggctgtagttacttactgtacgcgaagaggcccggttaggcggggtaaggttttccggggggaagtttggacctaaagttaaccgtaaccgttaacggttaaccggggtttaattcgggggtaaccgtttccggtacggggggaacccgaaacggggtaacccgaccgggttccgaaccccggttaccttcccgtaccgtaccgtacccgttaccccgaacccggtaaaccggggtaccccaacgttcccggttacccgttaccccccgtcgggtacccgtccccgttcggacccgttacccgaacggtaccgtccgttaacccgtccggtacgggggccgaacccggaccgggtccgggaccccggtcggggtcccgtccggtcccggtacggtaccgtaacggtacccttaccgttcccgtaccggacgtccggtccgttaccgg

SEQ ID NO: 152361 - DNA, 618 bp, Homo sapiens
  misc_feature: GYAE6OF02IERCU.44.38.D05.1.454.CMB.1.raw
  modified_base (333)..(333): a, c, t, g, unknown or other
  misc_feature (333)..(333): n is a, c, g, or t
  modified_base (401)..(401): a, c, t, g, unknown or other
  misc_feature (401)..(401): n is a, c, g, or t
tcagacagtatatacacgaccggtgctcgatttagtatctgatagtggagtccgggggaggcttagttcagcctgggggggtccctgagactctcctgtgcagcctctggatttcacctttcagtagctactggatgcactgggtccgccaagctccagggaaggggctggtgtgggtctcacgtattaatagtgatgggagtagcacaagctacgcggactccgtgaagggccattcaccatctccagagaccaacgcccaaagaaccacgcctagtatctgacaaaatgaacagtctagagacgaccggagaccaggctgtgtactttacngtgacaagcgccggtgcgggtgttcggggagttgactatactactacgtaggtatagggcgttacggnggggaccgtaacgggaccgtaccggtccaccgtcctcctcacgtccttcccaacgaacggacccacgttccggttcccgttccccgtcggtcccgcccgtcgcctccgacggcgccgtaccgtcgtacggggccacgcggccgcccgtcgggccgtcggcccgttcgggtaccgaacggtaccttaccgttaccttacgttacttaccgtgttccgg

SEQ ID NO: 152362 - DNA, 564 bp, Homo sapiens
  misc_feature: GYAE6OF02FO4F8.44.38.D05.1.454.CMB.1.raw
  modified_base (282)..(282): a, c, t, g, unknown or other
  misc_feature (282)..(282): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccattcaccatctccagagacaacgccaagacacgctgtatctgcaaatgaacngtctgagagccgaggacacggctgtgtatactgtgcaagagccggtgcgggtagtcggggagttgcgatactacactacggtatggacgtcgtggggaccaagggaccacggtcaccgtctcctcacgccttccaccgaacggcccagttccggtcccttccccgtggcccgccctcgccgtcccgacggacgtccacccgttcggcgggccaccgcggccggcccgtgggcctcgcccgtggtaccaacggtcttaccgttcctaactacttactgtaccg

SEQ ID NO: 152363 - DNA, 799 bp, Homo sapiens
  misc_feature: GYAE6OF02FGAA6.44.38.D05.1.454.CMB.1.raw
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagccgtggggggtccctgacgactctcctgtgcagcctctggatttccaccttcagtagctactggatgcgacgtcgggtccgccaagctccggagggagggctgggtgtcgggtctcgacgttaattaacgtagngtagtggggagtacgcaacgaagtcctacggaccggtactcccggtaggaaccggtcctaattccaccatccaccaggacactaacgaccaaagtacnctcgttagtacctgtaagaactaaagtcggaaaacctcggtacgacggaagaccggtaccggaagggtaccgacgggtcttaggtaacgtttaattacccggtaggtacggaacccgtaaaggggtccggggtcccgggtttaggggacccggggtttaacgggttaccgggggtagttaccggtaactaaccgtttaaacgtaacccgtaacggttacgggttaacgtacggggttaacccgtacgggtaaccggggtaaccgtaaaccgggaccgtaaccggtaccgtacccgtacccgttaccgtacgtccgtaacccttacccgaaccggaccggttacccgtaccgttacccggttcccgttacccggccggtcccgtcccgtgtacccgaccggtacggcccgacgtacccggtaccgggcggggtaaccc

SEQ ID NO: 152364 - DNA, 314 bp, Homo sapiens
  misc_feature: GYAE6OF02HVPOW.44.38.D05.1.454.CMB.1.raw
  modified_base (308)..(314): a, c, t, g, unknown or other
  misc_feature (308)..(314): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaaggcccatcggtcttccccctggcgccctgctccaggagcacctctggaggcacagcggccctgggctgcctggtcaaggactacttcctatatactgtctgagcggctggcaaggcgcatagnnnnnnn

SEQ ID NO: 152365 - DNA, 656 bp, Homo sapiens
  misc_feature: GYAE6OF02JE4WF.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggatagcacaagctacgcggactccgtgaaggccgattcaccatctccagagacaacgcaagacacgctgtatctgcaaatgaacagttctagagagccggaggacacggctgtacgtattacgtgtgctaagagccggtggccgggtaggttacgggggtagttgacactacgtactacgtacggtatgggaccgtcgtcggggaccgaagggaccgtacggtcgaccgtctcctcgagccttaccaccgaacggcccagtccggtccttcccctggccgtcccgtacgccttaccgacgggacgaccgtacccgttcgggtacggggtaccgaccgtaccggtccggggtcccccggtacggggcccgttccgggcccgttaccggggtacccgtaaaccgggttacccgttaacccgtttccccgtaaccggtttccgtaacccggttagtacccggg

SEQ ID NO: 152366 - DNA, 623 bp, Homo sapiens
  misc_feature: GYAE6OF02H2Z5X.44.38.D05.1.454.CMB.1.raw
tcagacagtatatacacgaccggtgctcgatttagtatctgatagtggagtccgggggaggcttagttcagcctgggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccattcaccatcctccagagacaacgccaaagaaccacgctgtatctgacaaatgaacagtctgagagccgaggacacggctgtgtattactgtgacgaagagccggtgcgggtaggttcggggagttgctaatacgtactactacggtatacgggacgtcgtcgggggaccgaaacggggtacccacgggtcctaacccggttccgtaccctcgacgtccttacccgaacccgaacgggtcccctacgttccggttaccctttcccccgtggcccgtccccgtcgccttcccgaggccgcctacccgtcggtcggggccacgacggcccggcccgtgggcctcggccgtggtaccgaacggtaccttaccttacctactactacgtgtacgg

SEQ ID NO: 152367 - DNA, 597 bp, Homo sapiens
  misc_feature: GYAE6OF02GQKOA.44.38.D05.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaagggctggtgtggtctcacgtattaatagtgatgggagtagcacaagctacgcggactccgtgaagggccattcaccatctccagagacacgcaagaacacgctgtatctgcaaatgaacagtctgagagccgaggacacggctagtgtattacngtagcaaagnggccgggtggccgggtaaggttccggggagttggactaataccgtacttaccgtaagggtatcgggaacgttcgtaggggacccgaacgggaccgacggtcgaccgtctcctcgacgtccttaccaccgaacggacccacgtccggtccttccccgtcggccgccctcgcctccgaggacgccaccgtccgtcggggctaccgcgccggcccgtcgggcctcggccgtggtaccaacgggtacttaccgttccgttatacttacctcgttacg

SEQ ID NO: 152368 - DNA, 261 bp, Homo sapiens
  misc_feature: GYAE6OF02GB1VY.44.38.D05.1.454.CMB.1.raw
  modified_base (257)..(261): a, c, t, g, unknown or other
  misc_feature (257)..(261): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnn

SEQ ID NO: 152369 - DNA, 285 bp, Homo sapiens
  misc_feature: GYAE6OF02I02K0.44.38.D05.1.454.CMB.1.raw
  modified_base (259)..(285): a, c, t, g, unknown or other
  misc_feature (259)..(285): n is a, c, g, or t
tcagacagtatatacacgaccggtgctcgatttagtatctgatagttgggtttgggggagttgcatactactactacggtatggacgtctgggggccaagggaccacgggtcaccgtctcctcagcttccaccaagggcccatcggtcttccccctggcgccctgctccaggagcacctctgggggcacagcggccctgggctgcctggtcaaggactacttcctatatactgtctgagcgggctggcaggcgcatagnnnnnnnnnnnnnnnnnnnnnnnnnnn

SEQ ID NO: 152370 - DNA, 303 bp, Homo sapiens
  misc_feature: GYAE6OF02H2Z8L.44.38.D05.1.454.CMB.1.raw
  modified_base (261)..(266): a, c, t, g, unknown or other
  misc_feature (261)..(266): n is a, c, g, or t
  modified_base (268)..(303): a, c, t, g, unknown or other
  misc_feature (268)..(303): n is a, c, g, or t
tcagacagtatatacacgaccggtgctcgatttagtatctgataggttgggtttgggggagttgcactactactactacggtatggacgtctggggccaagggaccgacggtcaccgtctcctcagcgttccaccaagggcccatcggtcttcccctggcgccctgctccaggagcacctctgggggcacagcggccctgggctgcctggtcaaggctacttcctcgatcgcgtctgagcgggctggcaaggcgcagtagnnnnnngnnnnnnnnnnnnnnnnnnnnnnnnnnnnnnnnnnnn

SEQ ID NO: 152371 - DNA, 287 bp, Homo sapiens
  misc_feature: GYAE6OF02JCHNM.44.38.D05.1.454.CMB.1.raw
  modified_base (254)..(254): a, c, t, g, unknown or other
  misc_feature (254)..(254): n is a, c, g, or t
  modified_base (260)..(287): a, c, t, g, unknown or other
  misc_feature (260)..(287): n is a, c, g, or t
tcagacagtatatacacgaccggtgctcgatttagtatctgatagttggggtttggggagttgcagtactactactacggtatggacgtctggggccaagggaccacggtcaccgtctcctcagcttccaccaagggcccatcggtcttcccccctggccgccctgctccaggagcactcgtggggcacagcggccctgggctgcctggtacaaggactacttcctcgatcgcgtctgagcggctggcaaggcncatagnnnnnnnnnnnnnnnnnnnnnnnnnnnn

SEQ ID NO: 152372 - DNA, 599 bp, Homo sapiens
  misc_feature: GYAE6OF02FGLIL.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattactgtgcaagagccgggtggcgggtaggttcggggagttgcatactactacgtacggtatgggacgtcgtggggaccgaagggaccgacggtcacccggtcctcctcacgtccttccgaccgaacgggcccacgttccggtcccttcccccgtgggcccgcccgtgcctcccgaggacgccaccgtcgtcggggccacgacggccggcccgtcgggcctcggcccgtacggtccgaaggtacccttaccgtttaccgtacttaacgttaccttcgttaccgg

SEQ ID NO: 152373 - DNA, 666 bp, Homo sapiens
  misc_feature: GYAE6OF02F87O3.44.38.D05.1.454.CMB.1.raw
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcggtcggccccgaggtacggggggtccctggacgactctccgtgtgcacgcctctggattccaccttcgaattaattggaatactgcgtaggtcgggtacccgcgaggcctccgagggcggaggggcgtggaggtgggtggcgtagggtgtgtctagtttacgagtaggaagtaatcgaagtcgtacggtgttacgttcggttaggcgggtaccgtacgttccgaacctacgtcctaccgagtaagaacctaacgttaccgaagaaccacgtagtcgttcttacttaacgaactagaacacgcctacgacgtacctaacgtacggaacgaccggtccgttagtttacgtttgtcggtaccgtacgtaccgttagttaccgtttacgtttaaccgtaaacggtttccggttacgttacgttcccggttacggtcccggtaacggg

SEQ ID NO: 152374 - DNA, 686 bp, Homo sapiens
  misc_feature: GYAE6OF02FYJ3F.44.38.D05.1.454.CMB.1.raw
  modified_base (216)..(216): a, c, t, g, unknown or other
  misc_feature (216)..(216): n is a, c, g, or t
tcagacagtatatacacgaccggtgctcgatttagtatctgatagtggagtccgggggaggcttagttcagtcctggggggtccctgagactctcctgtgcagcctctggattcacctttcagtagctactggatgcactgggtccgccaagctccagggaagggctggtgtgggtgcaggtgtgtcatttcatggaggaaatcaagtctacggtnattccgttgagggccattcaccatctccagagacaacttccgagaacacagtgtctcttcaaatgaacagcctgagacctcaggacacggccgtgtattttgtagcgagactatctgttaccaaaagtcggttacattcgacgtcctggggccagggaacccggtcaccgtactcctcggcctccaccgaagggccccagtccggtaccttcccccgtgggacccgtcccgtcggtcccttccgaacgggtacgacctaaccccgttccgaacggacggccaacgaacggcccgggtacccgtcggggcctttcgggacccttcggggtaccgtaaacgggtacccgttaacccgttttaccccggaaccggtttacccgtaaaccgtttccgggtaccgtttacgggaaccgggtccgggggtaaccttcgggggaacccgtaacggggttaccggaccgttaaaccgg

SEQ ID NO: 152375 - DNA, 770 bp, Homo sapiens
  misc_feature: GYAE6OF02H6GDO.44.38.D05.1.454.CMB.1.raw
  modified_base (424)..(424): a, c, t, g, unknown or other
  misc_feature (424)..(424): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccgagggaggggctgggtgtgggtctcacggttattaatagtgagtggggagtagcaacaagcgtaaccggcggtacctccgtagggaacgggccgtattaccaccattcctccaagacgaaccaaccgaccaaagaaccacgcttgtaacttctaggaacaaattcgaaactacgtacgtagacggacggaccggaacggaccgaacggtntacggttagttacttacgttgtggacctaaggacggccgggtagggcggggtagggttcgggggtagttggacaattaccgttaacgttaccgttaacggggttaagtcgggtaaccggtcggttcggggaccggtaaaccggggaccgaccggggtaacctacccggtccttacccgtacggtaccgttacgtacccccgaacgtaacccgggacccttaccggttccccggttaaccccgttcccccgttaaccggggtccggtccccccggttacgttaccccggtcccgtaacgggacccggtaccccgtaacccgtttcccgggggacgggggtaaccccg

SEQ ID NO: 152376 - DNA, 572 bp, Homo sapiens
  misc_feature: GYAE6OF02IYE1B.44.38.D05.1.454.CMB.1.raw
  modified_base (287)..(287): a, c, t, g, unknown or other
  misc_feature (287)..(287): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgacaaatgaaacngtctgagagccgaggacacggctgtgtattactgtgcaagagccggtgcgggtagttcggggagttgcaatactactactacggtatgggacgtcgtggggaccgaagggaccgacggtcaccgtctcctcacgtcttccaccgaacggccacgttccggtccttccccgtcggccgcccgtcgcctccgaggacgccgtaccgtcgtcggggccaccgacggccggcccgtcgggctcggccgtcggtacgaacggtactaccttacctagtacttacgtgtcg

SEQ ID NO: 152377 - DNA, 567 bp, Homo sapiens
  misc_feature: GYAE6OF02GV90O.44.38.D05.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (554)..(554): a, c, t, g, unknown or other
  misc_feature (554)..(554): n is a, c, g, or t
tcagacagtatatacacgaccggtgctcgatttagtatctgatagtggagtccgggggaggcttagttcagcctggggggtccctgagactctcctgtgcagcctctggattcaccatcagtgaccactatatggactgggtccgccaggctccagggaaggggctggagtggcttggccgcagtaaaaacaagttgccagctttancacagagtacgccgcgtctgtgaaagccagtacttccaccccttctcaagagatgacttcaagaactcattgattcngcgaatgactaacctagaaaaccgaggacacgggcagtgtattattgtgttgtgtttatatcagaactgtccacgtggggcacgggacccgtggcaccgtctcctcacgcctccacgaacggcccatccggtccttccccgtggcccgccctcgcctccgagggacgcctacccgtaccgacgacgccaccgagcccggcccgtcgggctcggccgtcgtcgaaggaccttacctttccgtaattacttactcgtctggacgcgggtcgnggcgacggcgacg

SEQ ID NO: 152378 - DNA, 278 bp, Homo sapiens
  misc_feature: GYAE6OF02GTJBT.44.38.D05.1.454.CMB.1.raw
  modified_base (259)..(278): a, c, t, g, unknown or other
  misc_feature (259)..(278): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccgatcggtcttccccctggcgccctgctccaggagcacctctgggggcacagcggccctgggctgcctggtcaaggactacttcctatatactgtcttgagcgggctggcaaggcgcatagnnnnnnnnnnnnnnnnnnnn

SEQ ID NO: 152379 - DNA, 694 bp, Homo sapiens
  misc_feature: GYAE6OF02ISY0B.44.38.D05.1.454.CMB.1.raw
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagacagtatatacacgaccggtgctcgatttagtatctgatagtggagtccggggggagcttagttcagcctggggggtccctgagactctcctgtgcagcctctggattcacctttcagtagctactggatgcactgggtccgccaagctccgagggaagggctggtgtgggtctcgacgtattaanagtgatgggatagcacaagctacgcgactcgtgacggccatcacntctcagagacaacgccaagaacacgctgtatcngacaaatgaacagtctgagacgccgaggcacggctggtntatcgtgtncaaggcgcggtggcggtaggttcgggattgctagtaactacgtacgtaacggtatcggtaccgttcggtacggggaccgtaacgggaaccgtaccggtacccgtaccgttcctacccgtcgaacgttcccttaccccgaaaccggtaaccgggtccctacgtttcccggttaccctttcccccgtcgggcccgtccccgtcggtacccttaccggacggaccgtcccgtaacccgttcggggtacggggacccaacgggtaccgggcccgggttcccggtggggtacccgttccggacccgggttacggttacccggtaaacgggttcccttaacccgtttacccgtaacgtttaccgtttaccggtacgttaccggg

SEQ ID NO: 152380 - DNA, 288 bp, Homo sapiens
  misc_feature: GYAE6OF02GFBX0.44.38.D05.1.454.CMB.1.raw
  modified_base (261)..(288): a, c, t, g, unknown or other
  misc_feature (261)..(288): n is a, c, g, or t
tcagacagtatatacacgaccggtgctcgatttagtatctgatagttggggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacgttcctatatactgtctggagcgggctggcaagggcgcatagnnnnnnnnnnnnnnnnnnnnnnnnnnnn

SEQ ID NO: 152381 - DNA, 748 bp, Homo sapiens
  misc_feature: GYAE6OF02HNQ1B.44.38.D05.1.454.CMB.1.raw
  modified_base (392)..(392): a, c, t, g, unknown or other
  misc_feature (392)..(392): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagccgtggggggtccctgagactctcctgtgcagcctctggattcaccttcagtagctactggatgcacgtgggtccgccaagtcctccgaaggggaaggggctggtgtgggtctacgacgttattaagtagtgaagtgggagtagcaacgaagctaacggcggactccggtggaaggccgatcacatctaccagagaacaacgacctaaaggaaccacgtcctagtactcgtaggaacaaaataggaaacagtactagaggngacccgaaggacacgggtactgtaggttaactacgttagtacgaacgaacggtaggtcccgggtaggccgggggttaaagggtttaccgggggtagttacggtacttaacggtaaccttaaccgtaacgtaacggttaagtacgggaacgtcggttacggggaaccgtaaacggggaccgaaccgggtaccgtacccgtccgttacccgtacttaccggaccgtttacccgaaaaccggtaacgggtcccgtacggttcccggtttaccccgttccccgtaccgggtcccgtccctaccggtcccgtacccggtagggaccctaccgtaaccggttcccgggtaggggtaaccccg

SEQ ID NO: 152382 - DNA, 290 bp, Homo sapiens
  misc_feature: GYAE6OF02IUUD4.44.38.D05.1.454.CMB.1.raw
  modified_base (262)..(290): a, c, t, g, unknown or other
  misc_feature (262)..(290): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctcgtgggggcacagcggcctgggctgcctggtcaaggactacttccacgtctactgctgaggcgggctgggacaagggcgcagtagnnnnnnnnnnnnnnnnnnnnnnnnnnnnn

SEQ ID NO: 152383 - DNA, 882 bp, Homo sapiens
  misc_feature: GYAE6OF02GKJXB.44.38.D05.1.454.CMB.1.raw
  modified_base (526)..(526): a, c, t, g, unknown or other
  misc_feature (526)..(526): n is a, c, g, or t
tcagacagtatatacacgaccggtgctcgatttagtatctgatagttgggtttgggggaagaggaagactgacggtcctcccaggagttcaggtgctgggcaccttgggcacggggggagcttagttcagccggtgggggtccctgagactcctcctgtgcacgcctcgtggtattcctaccttcagtagccttacgtggatgcctacggttcgggtcccgaccgaacgtcctaccgggaagggggaacggggtcgttgggttgggtcgggtcctacgtaacgttaattaaagtaggtaggtaggtaggggaagtacgaccaacgaacgtccgtacggaccggttaccgtccggtaggaaccgggtaccgtacttacccacgtacttccgtacgaaggaacgaaacccgaaacccggaccgaaaacgaacccgtaccgtacgtttacgtaacttcgaacgaactaaagtaacgaacctaggttcgtaagacgggacgaaccggacggtaaccgtggtcttaggttnttaaccgtttcgtggtacggaaccgaaacgggtccggggtacggggtacgggtacggggttacggggttacggggtaagttacgaaccgttaaacttaaccgttaaaccgtaacgggttaacgggttacggtaacgggttacccggttacgggggacgggaacccggtaaaccgggtaacccgtaccggtacccggtaccgttccgtacctaccgtaacccgtccctaacccggaaacccggtaccggttacccgtacccggttccccggtttcccgttcccccggtcggtaccccgtcccgtcggtaccgacccggtacggacccgtcccggtacgggtaccggacggtacccgg

SEQ ID NO: 152384 - DNA, 319 bp, Homo sapiens
  misc_feature: GYAE6OF02F5KME.44.38.D05.1.454.CMB.1.raw
  modified_base (311)..(319): a, c, t, g, unknown or other
  misc_feature (311)..(319): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggtccatcggtcttccccctggcgccctgctccaggagcacctctgggggcacagcggcccctggggctgcctggtcaaggactacttccacgtctactgctgagcggctggcaaggcgcatagnnnnnnnnn

SEQ ID NO: 152385 - DNA, 312 bp, Homo sapiens
  misc_feature: GYAE6OF02GEPAL.44.38.D05.1.454.CMB.1.raw
  modified_base (308)..(312): a, c, t, g, unknown or other
  misc_feature (308)..(312): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggctacttcctcgatcgcgtctgagcgggctggcaaggcgcatagnnnnn

SEQ ID NO: 152386 - DNA, 702 bp, Homo sapiens
  misc_feature: GYAE6OF02ITFM0.44.38.D05.1.454.CMB.1.raw
  modified_base (307)..(307): a, c, t, g, unknown or other
  misc_feature (307)..(307): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattccaccatcctccagacgacacgccaaagaacacgctgtatctgacaaatgaacagtctgagagccgaggacncggtctggtgttacttacgtgtgacgaaggacggccgggtgggacggggtagggttcggggggtagtttcggactaacgttaaccgttaaccttaacggttaacggttagtacggggtaccggtttcgggtacggggggacccgtaaacggggaaccccgtaccgggttacccgacccggttcccttcccgtacgacgtacccttaccccgaacccggaacgggcccctacgttccccggttcccgtttccccccggtccggtcccgtccccgtcgtcccgtacccgagggtaccgcccgaccgttcggacgggccacgcggccggccgtcgggccgtcggtccgtggtaccgtaacggtaccttaccgttccgaccgtaccttacgtcggtacg

SEQ ID NO: 152387 - DNA, 341 bp, Homo sapiens
  misc_feature: GYAE6OF02JEVLR.44.38.D05.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (321)..(341): a, c, t, g, unknown or other
  misc_feature (321)..(341): n is a, c, g, or t
tcagacagtatatacacgaccggtgctcgatttagtatctgatagttgggtttgggtcgaccgaggacacggctgtgtattactgtgcaagagccggtgcgggagttcggggagttgcgatactactactacggtatggacgtctggggccaagggaccacggtcaccgtcgtcctcagcttccaccaagggcccatcggtcttccccctggcgccctgctccaggngcacctcgtggggcacgacgcgcccnggctgccgtggcaaggcctactccgtatatactcgtctggacgcggcgtggacgaacggcgcagtagnnnnnnnnnnnnnnnnnnnnn

SEQ ID NO: 152388 - DNA, 361 bp, Homo sapiens
  misc_feature: GYAE6OF02G3US1.44.38.D05.1.454.CMB.1.raw
  modified_base (339)..(361): a, c, t, g, unknown or other
  misc_feature (339)..(361): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaaggcccatcggtccttcccccgtggccgccctgcctccaggagcacctcgtgggggcacgagccggcccgtgggctcgccgtggtacaacggacttaccttcctatactactcgtcgtggacggcgggtcgtacggacgaacggcgactagtagnnnnnnnnnnnnnnnnnnnnnnn

SEQ ID NO: 152389 - DNA, 314 bp, Homo sapiens
  misc_feature: GYAE6OF02JH9IV.44.38.D05.1.454.CMB.1.raw
  modified_base (299)..(299): a, c, t, g, unknown or other
  misc_feature (299)..(299): n is a, c, g, or t
  modified_base (305)..(314): a, c, t, g, unknown or other
  misc_feature (305)..(314): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctggctgcctggtcaaggctactccacgtctactgctgagcggctggcaaggcncatagnnnnnnnnnn

SEQ ID NO: 152390 - DNA, 660 bp, Homo sapiens
  misc_feature: GYAE6OF02IQHJW.44.38.D05.1.454.CMB.1.raw
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagccgtggggggtccctgagactctcctgtgcagcctctggattcaccttcagtagctactggatgcacgtgggtccgcaagcctccgaggggaagggctgggtgtgggtctcgaacgtattaagtagtgagtgggagtagcacaagctacgcgactcgtgaaggccattcaccntcncaganacacgcaagaacncgctgtatctagacaaatgaacngtcagagagccgaggacacggctgtagtattacnggtagactaaagcggccggtggacgggtaggtttcggggagttcgactaacgttaacttacgtaacgtaacggtagtacgggacgttcggtacggggaccgtaaacggggacctaaccgggtaccgtacccgtccgttacccgtaccgacgtccccttaccgaacccgaaccggggtaccccacgttccggttaaccccgttcccccggtcggtacccggccccgttcggccctacccggtacgggacccgaccgtacccgttcgggtccgggaacccg

SEQ ID NO: 152391 - DNA, 800 bp, Homo sapiens
  misc_feature: GYAE6OF02GMVSY.44.38.D05.1.454.CMB.1.raw
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
tcagacagtatatacacgaccggtgctcgatttagtatctgatagttgggtttggggggaagaggaagactgacggtcctcccaggagttcaggtgctgggcaccttgggcacggggaggcttagttcagcctggggggtccctgagactctcctgtgcagcctctggattcaccttcagtagctactggatgcacgtgggtccgccagctccgagggagggctggtgtgggtctcgacgtattaatagtgagtgggagtagcacaagcgtacgcgtactccgngaacgggccattcaccgtatcctacagacgacaacgaccaagaacacgctgtacnctagactaaatgaactacggtctagagtacgacccgaaggaccgaccggcgttaggttagttaacgttacgtcggttaggacgtaaacggccgggaccgggtcgggtacggggtacggggtttacgggggtacggtttacggtacgtaacgttaacgttaaccgttaaccgttacgggttaacggtacgggtaaccggttaccgggtacggggtacccggtaaccggggaacccggtaaccgggttacccgtacccgttcccgttacccgttaccggtaccgtacccgttacccgtaacccggtaacccgggtaccccgtaccgttcccgggtttacccccggtttccccccggttacccgggtccccggttacccccgttacccggttccccgttaccccggtaaccgggacccgggtacccggtaaccccgggttccgggtacccggggggtaccccgg

SEQ ID NO: 152392 - DNA, 714 bp, Homo sapiens
  misc_feature: GYAE6OF02FGRZT.44.38.D05.1.454.CMB.1.raw
  modified_base (328)..(328): a, c, t, g, unknown or other
  misc_feature (328)..(328): n is a, c, g, or t
  modified_base (390)..(390): a, c, t, g, unknown or other
  misc_feature (390)..(390): n is a, c, g, or t
tcagacagtatatacacgaccggtgctcgatttagtatctgatagttgggtttggggggaagaggaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccgagggaaggggctgggtgtgggtctcacgttattaaccaccgatgggactatcactggttactcagacgccgtgaagggccattcatcatctccagagacaatgtacgaaaacncggtagtatttaacaaatgaacagtactaagagtacgaggacacggctgtctacttagttgngtgagtacctttatgtactttcgacggtttagggggatttagtcgggtttcgggacccctacgtacggttcggggaccgaacgggttaaccgttgggtccgttaccgtccgtccgtcgacgttcccttacccgaaccgacgggtacccctacgttacccggttccctttcccccggtaggtccccgttccccgttaccccgtacccgaacggtacccggtccctaacccggttcccggggttaccgggggaccctaaccgggaacccggtccccggggtaccccggttacggggtccccgtccgggttaccccgttaaccgggg

SEQ ID NO: 152393 - DNA, 260 bp, Homo sapiens; identical to SEQ ID NO: 152156
  misc_feature: GYAE6OF02H8JRP.44.38.D05.1.454.CMB.1.raw
  modified_base (257)..(260): a, c, t, g, unknown or other
  misc_feature (257)..(260): n is a, c, g, or t

SEQ ID NO: 152394 - DNA, 636 bp, Homo sapiens
  misc_feature: GYAE6OF02IRQHV.44.38.D05.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
tcagacagtatatacacgaccggtgctcgatttagtatctgatagtggagtccgggggaggcttagttcagcctgggggggtccctgagactctcctgtgcagcctctggattcacctttcagtagctactggatgcactgggtcccgccaagctccgagggaaggggctggtgtgggtctcgacgtattaatagtgatgggagtagcacaagctacgcggactccgtgaggccattcaccatcnccaganacaacgccaagaaccacgctgtatctgacaaatgaacngtcgtagagagccggaggacacggctgtgtattacgtgtgacaagagccggtggcgggtaggttcggggagttgctaagtacctactaacgtacgggttatgggtaccgttcgtcgggggaccgaacgggaccgaccgggtaccgacccgtcctccgtcacgtccttacccaccgaacggccctacgtcggtccttccgacccgtcggccgtcccgtcgcccgtaccgacggacgccgtacccgtcgtcggggccacgcggcccggtcccgtcgggtccgtaccggtcccggttacggtaccgtaacggtaccgttaccgttacccgtaacttacgtacgttaccgg

SEQ ID NO: 152395 - DNA, 680 bp, Homo sapiens
  misc_feature: GYAE6OF02JQ93X.44.38.D05.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
tcagacagtatatacacgaccggtgctcgatttagtatctgatagtggagtccggggaggcttagttcagcctggggggtccctgagactctcctgtgcagcctctggattcaccttcgagtagctactggatgcacgtggtccgcaagctccgagggaagggctggtgtggtctacgagttattaatgtgagtgggagtagcanaagctacgcggactccgtgaagggccattcacctatctccagganacgacgccaaagtaccacgctagtatcagacaatcgaactgctgagtacgccgagaccgtacggctggtctaatcgngtagacaaggtcgcggtagcggtagttcggggatgacagttactacgtataacggtatcgggtaacgtccgtaggggaaccgaaacgggtcctaacgggtcctaaccggtcctcttaccgacgttcccgttaccgaacccggaaacgggtcccttaaagttccccggttaccctttcccgtcgggtaaaccccggtccctcggttcccaaaccggcggttccgaacccgttccgttccgggtcgggacgtaaccgccgggttcccggaacccggtttacgggcccttgggaccccgtttagggacctaacgggtaccttacggttcccctaaaggtttcctacgttgtaccgg

SEQ ID NO: 152396 - DNA, 261 bp, Homo sapiens
  misc_feature: GYAE6OF02JC5DH.44.38.D05.1.454.CMB.1.raw
  modified_base (251)..(251): a, c, t, g, unknown or other
  misc_feature (251)..(251): n is a, c, g, or t
  modified_base (257)..(261): a, c, t, g, unknown or other
  misc_feature (257)..(261): n is a, c, g, or t
tcagacagtatatacacgaccggtgctcgatttagtatctgatagttgggtttggggtagttgcatactactactacggtatggacgtctgggccaagggaccacggtcaccgtctcctcagcttccaccaaggcccatcggtcttcccctggccgccctgctccaggagcacctcgtgggggcacagcggccctgggctgcctggtcaaggctacttccgtatatactgtctgagcgggctggcaaggcncatagnnnnn

SEQ ID NO: 152397 - DNA, 268 bp, Homo sapiens
  misc_feature: GYAE6OF02G62QS.44.38.D05.1.454.CMB.1.raw
  modified_base (257)..(261): a, c, t, g, unknown or other
  misc_feature (257)..(261): n is a, c, g, or t
  modified_base (263)..(268): a, c, t, g, unknown or other
  misc_feature (263)..(268): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnngnnnnnn

SEQ ID NO: 152398 - DNA, 663 bp, Homo sapiens
  misc_feature: GYAE6OF02GXGE1.44.38.D05.1.454.CMB.1.raw
  modified_base (268)..(268): a, c, t, g, unknown or other
  misc_feature (268)..(268): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
tcagacagtatatacacgaccggtgctcgatttagtatctgatagtggaggtccgggggaggcttagttcagccgtggggggtccctgagactctcctgtgcagcctctggattcaccttcagtagctactggatgcacgtgggtccgccaagctccgaggggaacgggctggtgtgggtctcacgttattaatagtgatgggatagcacaagctacgcggactccgtgaagggccattcaccatctcagacgacaacgccaagaacncgctgtatctgacaaatgaacagtctaggagacggccggaaggtaccacggtcttaggtcttaacgtttacgtgttacgaccgtaaagggacgtcccgggttagggccggggtaaggtttccgggggattgactaacgttaccttaacgtaacgtaagggtatcgggaaccgttcgtaacggggccaaacgggccctacggtccaccgtctccgtacgacgtccttaccgaccgtaaggtccctagttccgtccttcccgnggcccncccgtgaccctcgacgagtccaccgttcggacgggtacaccgtacggccgtaccgtacgggccttacggccggttacggtaaccgtacggtaccttaccgttacccgtaacgtcgttacttggtaccg

SEQ ID NO: 152399 - DNA, 707 bp, Homo sapiens
  misc_feature: GYAE6OF02FHHNL.44.38.D05.1.454.CMB.1.raw
  modified_base (315)..(315): a, c, t, g, unknown or other
  misc_feature (315)..(315): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagcctggggggtccctgagactctcctgtgcagcctctggattccaccttcagtagctactggatgcacgtgggtcccgccaagcctccgaggggaacgggctgggtgtcgggtctcacgttattaatagtgagtgggagtagcaacaagctacgcggactccgtagaacgggccattcaccatccncagacacaacgcaagacacgctagtatctgacaaagtgaacagtctgaacgtacgaccggaggaccacggcttgtacgttatttacgtaggtcgaaccgtaaggacggtccgggttcgggccggggtagggttccgggggtaggttcgacgtaacgtaccgtaaccgttaccgtaacggttacggtacgggtacggttccggtacggggtaccggaaaccggggtacccgtaccgggtacctacccggttacctccgttaccgtaccgtcccttacccgaaccgtaacggcccctaccgttccggtacccgtttcccccggccggtccccggtccccgtacggtcccgtacccgacggtaccgcccggtacccggtccggtccggggacccg

SEQ ID NO: 152400 - DNA, 741 bp, Homo sapiens
  misc_feature: GYAE6OF02INRKF.44.38.D05.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
tcagacagtatatacacgaccggtgctcgatttagtatctgatagttgggtttgggggaagaggaagactgacggtcctcccaggagttcaggtgctgggcaccttggtcacgggggaggcttagttcagccgtggggggtccctgagactctcctgtgcagcctctggattcaccttcagtagctactggatgcactgggtccncaagctccagggaagggctggtgtggtctcacgtattaanagtgatgggagtagcacaagcgtacgcggacgtccgtagaagggccggattcaccatctaccacgagacaacgaccaaacgaacacgactgtaactctagggggacaaacgtagaaacgtacgtacgtagagaacgaccggaacggacgacggacgtaggtagtagttaacgtgtagacgaagacggacggtcggtacgggtacgggttacggggtaggttcggtacgtacgttaacgtaacgttaacgttaacggttaacgttaggtaacgttcggtcggtacggggttaaccgggaaacgggtaaccggtaaccgggttaccgtaacccgttccgttacccgttaccgaaccgttaccgttacccgaaccgtaaccgggtacccgtaccggttacccgggttcccgttccccgttccgggtacccggtccccgttaccggtacccgttacccggtacggtaccggtaccgtacccggttaccggtacccggggg

SEQ ID NO: 152401 - DNA, 258 bp, Homo sapiens
  misc_feature: GYAE6OF02GIHHI.44.38.D05.1.454.CMB.1.raw
  modified_base (256)..(258): a, c, t, g, unknown or other
  misc_feature (256)..(258): n is a, c, g, or t
tcagacagtatatacacgaccggtgctcgatttagtatctgatagttgggttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcggctggcaaggcgcatagnnn

SEQ ID NO: 152402 - DNA, 645 bp, Homo sapiens
  misc_feature: GYAE6OF02FOP55.44.38.D05.1.454.CMB.1.raw
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (559)..(559): a, c, t, g, unknown or other
  misc_feature (559)..(559): n is a, c, g, or t
tcagacagtatatacacgaccggtgctcgatttagtatctgatagtggagtccggggggaggcttagttcagccgtgggggggtccctgagactctcctgtgcagcctctggattcacctttcagtagctactggatgcactgggtccgccaagctccgaggggaaggggctgggtgtgggtctcacgtattaatggtgagtgggatagcaacaagctacggcggactccggtggaagggccattccacatcnccagacgacacgaccaagaacacgctgtatctgacaaatgaactagtcnggagacgcgaggacacggntgtagttacttacgtggtagacaaggcggtccgggtggtcggggtacgggttcgggggattggccgaattaccgtaactacgtacgggttatggtaccggttcggtacggggaccgaaacgggaccgaccggtaccgaccgtcctccgtacacgtcctacccgaaccgtaccgggtaccctacgttcccggttcccgttcccccggtcggtcccgtccccgtcgccgtccgacggtcnccgtacccgtcggtcgggcacgcgccggccgtgggcgtcgccgtcggtacgaacggtacttacgttaccttatacgttcgtgtcgg

SEQ ID NO: 152403 - DNA, 281 bp, Homo sapiens
  misc_feature: GYAE6OF02JGPGH.44.38.D05.1.454.CMB.1.raw
  modified_base (260)..(281): a, c, t, g, unknown or other
  misc_feature (260)..(281): n is a, c, g, or t
tcagacagtatatacacgaccggtgctcgatttagtatctgatagtggagtccgggggaggcttagttcagcctgggggggtccctgagactctcctgtgcagcctctggattcaccttcagtagctactggatgcactgggtccgccaagctccgaggggaagggctggtgtgggtctcacgtaattaatagtgatgggatagcacaagctacgcggactcgtgaagggccatcaccatctccagagacaacgccaagnnnnnnnnnnnnnnnnnnnnnn

SEQ ID NO: 152404 - DNA, 658 bp, Homo sapiens
  misc_feature: GYAE6OF02HCYKF.44.38.D05.1.454.CMB.1.raw
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
tcagacagtatatacacgaccggtgctcgatttagtatctgatagtggagtccgggggaggcttagttcagcctggggggtccctgagactctcctgtgcagcctctggattcacctttcagtagctactggatgcactgggtccgccaagctccgagggaaggggctggtgtgggtctcacgtattaatagtgatgggagtagcacaagctacgcggactccgtgaagggccattcaccatctccagagacaacgccaagaacacgctgtatctgacaatgaacagtctagaagagccgaggaccncggtctggtgtattactgtcganaagcgaccgggtggcgggtaggttcgggggagttcgactagtactacgtacgtacggtacgtcgggacgtccggtcggggacccgaacgggaccgacgggttccgacccgttaccgtccctcgtacgtcccttacccgaacccgtaacgggcccacggttccggtacccttcccccgtcggtcccgtcccgtcgcctacccgagggcctccgacccgttcggacggggtacccacgtaccggccgggtccccggtcgggtcccgtcggtccggtccggttaccgaacggtaccgttaccttccgttaatacgttacgttcgttaccgg

SEQ ID NO: 152405 - DNA, 596 bp, Homo sapiens
  misc_feature: GYAE6OF02FKZR9.44.38.D05.1.454.CMB.1.raw
  modified_base (333)..(333): a, c, t, g, unknown or other
  misc_feature (333)..(333): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccattccaccatctccagagacaacgccaaagaacacgctgtatctgacaaatgaaacagtctggagacgccgaggacacggctgtgtattactgtgacaaggngccggtggcgggtaggttcggggattgacatactactactacggtatcgggacgtcgtgggaccgaagggaccgtacggtccaccgtctcctgacgtcctacccaccgaacggcccacgttccggtccttccccgtcggcccgccctgcctcgacgcgccaccgtcggtcgggccaccgacggcccggtccgtcgggcccgtcgtccggttcggtaccggaacggtacccttaccgtttacctaatacttaccgttgtaccgg

SEQ ID NO: 152406 - DNA, 673 bp, Homo sapiens
  misc_feature: GYAE6OF02F2WJO.44.38.D05.1.454.CMB.1.raw
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccgccaagctccgagggagggctggtgtgggtctcacgtattaatagtgagtgggagtagcacaagctacgcggactccgtagaacgggccattcacctatctcagacacacgccaagacacgtntgtatctagacaaatgaactagtcgtagagacgccgaggaccncggctggtcgtattacngtacgacaaggtccgccgggtggacgggttagggtcggggtagttcacgtagttaacctaagttacgtacgggttagcgggacgttcggacggggacgaacgggaccgtaccgtccgaccgtccgtcctcgacgtccttacccgaaccgaaccggtcccacgttcccgttcccttcccgtccggtacccgtcccgtccgccgtaccgacggaccgtaccgtccgtcggtcgggtcccaccggtaccggcccgggtccgtacggtccggtccggacccggttacggtaccggtaaccggttaccgttaccgtttacccgttaacgttactttacgtcggttaccgg

SEQ ID NO: 152407 - DNA, 594 bp, Homo sapiens
  misc_feature: GYAE6OF02G9LAN.44.38.D05.1.454.CMB.1.raw
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcacgccaccctcagtgtcagtcggccccaaggaaagacggccaggacttaccgtggtagggggaaacaacagttaggaaagtaaaagtgtgcacgtggtacagcagaagccgaggccacggccccctggtcgctggtcatctattatgataggccgaccggccctcgagggactcccgtgagccgtattctctggcctacaactcgtggaaccncggccaccctcgaccatcgngacgagggacgacggcggggancggacggccgactacgttacgtgtcgtaggtggtcggatagtagtagtgagtcgtagtcgggttggttacgggacgggtaacgggaccgaacggctacggacccgtcggtcgggcacggacccgaacggccgtccgtccccgtcggcctccgtcgttccgtcccctaccccg

SEQ ID NO: 152408 - DNA, 245 bp, Homo sapiens
  misc_feature: GYAE6OF02ILUJ1.44.38.D05.1.454.CMB.1.raw
  modified_base (138)..(138): a, c, t, g, unknown or other
  misc_feature (138)..(138): n is a, c, g, or t
  modified_base (145)..(145): a, c, t, g, unknown or other
  misc_feature (145)..(145): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (224)..(245): a, c, t, g, unknown or other
  misc_feature (224)..(245): n is a, c, g, or t
tcagacagtatatacacgaccggtgctcgattttagtatctgatagttgggtttggggggaagaggaagactgacggtcctcccaggagttcaggtgcgtgggcaccttgggcgaccgggggaggtgtgtcacaaggntttgggntctgggcacagccggccctgggctgcctggtcaaggactacttcctatatactgtctgagcgggntggcaggcnatagnnnnnnnnnnnnnnnnnnnnnn

SEQ ID NO: 152409 - DNA, 641 bp, Homo sapiens
  misc_feature: GYAE6OF02HMCSB.44.38.D05.1.454.CMB.1.raw
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
tcagacagtatatacacgaccggtgctcgatttagtatctgatagtggagtccgggggagcttagttcagcctggggggtccctgagactctcctgtgcagcctctggattcaccttcagtagctactggatgcacgtggtccgccaagctccgagggaggctggtgtggtcnctacgtatatgnagtggatncanagctacgcgactccgtgacgggcctatcaacgtntcctacagacgaccaacgacctaacgacacgtctagtactcncgacaaagtcgaacgtntacgagacgaccgacgaacggactaccggttctggttactactttacgnggtgaacacggtggcccggtggcgggtacggtgggtagttcgactaagtaccgttaacgttacgacggttagtacggtcgtacggtcggggaaccggacggaccgtaccggtccgtaaccgtctccgtacgcgtacctaccgaaccgaccgtaccgtccgtcccgttacctccccgtcggccttccgcgtcccgtaccacgggtacctccgtaccgttcgggacggtacgccggacgccgtccggtacggcgtaccgtccgtagccgttaacgtcttacctacgttactccgttacgtcgtcg

SEQ ID NO: 152410 - DNA, 778 bp, Homo sapiens
  misc_feature: GYAE6OF02F220L.44.38.D05.1.454.CMB.1.raw
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccgcaagctccgagggagggctggtgtggtctcacgtattaatgtgagtgggatagcacagctacgcggactcgtagacggcctattcacntcncagacgacacgcaagacacgtntgtatctgacaaatgaacacgtcnggaacgacggaccggaggaccgacggtgtggttagtacgtttacgnggtacgacgtaaggacggtccgggtaggaccggggttagggttcgggggtattcgactaagttaacctaacgtacggttacgtaggtcggtaccgtccgggtaggggacccgaacggggacctaccggtcccaaccggttccctaccgtcgtaaccgtccttaaccccgaaaccggtaaccgggtcccctacggtttccccggttcccccgttaccccggtccgggcccctaccccggttcgaccccggttaccggtaacgggaccgtaccccgtaccgggttaccgggaccgggggtacctaaccggggaccccgggtcccggtacccggtccggggttaccccgtaccgggttaccccgggtttagggaaccccggttaaaccggtaccccgtttttacccggttaccccgttaagttttacccggttaccgttccggttaaccggg

SEQ ID NO: 152411 - DNA, 717 bp, Homo sapiens
  misc_feature: GYAE6OF02FU439.44.38.D05.1.454.CMB.1.raw
  modified_base (145)..(145): a, c, t, g, unknown or other
  misc_feature (145)..(145): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagacagtatatacacgaccggtgctcgatttagtatctgatagtggaggtccggggagcttagttcagcctgggggtccctgagactctcctgtgcagcctctggattcacctttcagtagctactggatgcacgtgggtccnccaagctccgaggggagggctggtgtggtctcacgtattaatgtgagtgggatagcanaagctacgcgactcgtgacggccntcacatcncagagacaacgcaagacncgctgtacnctgacaaatgaacncgttacngagcggaccgaaggaccacggtctaggttagttaacttcgtgtacgacgtaaaggcggtccggtggacgggttagtttaccgggggntttcgactaagttacctaacgtaacccggttagggttatacggggtaccgtttccggacgggggaacccgtaaccgggtacccgaccggttaccgtacccggttccgtacccgtacgtaccgtacccgttacccgaccgtaaccgggtaccctacggttcccggttaccccgttaccccgtccggtcccgtacccgttcgacccgttaccggacggtaccgtcccgtaccggtcggtaccggggaccaccggaccggtccgggacccggtcgggtccgtaccgtaccggtcggtaaccgtaacggtaccgtttaccgtttaccgtaattaccgttacgtcgttacgg

SEQ ID NO: 152412 - DNA, 784 bp, Homo sapiens
  misc_feature: GYAE6OF02FS7CE.44.38.D05.1.454.CMB.1.raw
  modified_base (170)..(170): a, c, t, g, unknown or other
  misc_feature (170)..(170): n is a, c, g, or t
tcagacagtatatacacgaccggtgctcgatttagtatctgatagttgggtttggggggaagaggaagactgacggtcctcccaggagttcaggtgctgggcaccttcgggcacgggggaggcttagttcgagccgtgggggtccctgagactcgtcctggtgcagcctntggattcaccttcagtagctactggattcgcacgtgggtccgcaagcctcgaggggaagggctgggtgtgggtctcgacgttaattaagtaggtgacgttgggaagtacgacaacgaagtaccgtaacggccggtacgttacccggtgggaaacggggtcccgtaatttccaacctaacgtacccgtacccgaaggaacgaaccaaacggaccaaaaggtaaaccgacggtccgtttaaggtacttccgtaagaacctaaaagttcgtaaaacaacgggttcctaaggacggaaccgtccgggaacggtacgaacgggtcgtagtcgtttaacgttacgtggtacgtacgaagtacgggtccgggtacgggtacggggtacggttacggggtagttgacgtaactaccgtacgtactacggttagtcggtacgttacggtcgggacgtaacgggacgtaccggtaccgtaccgtaccgtccgtacgtactccgttaaccctaccggaaccggtcccgtaccgttccggttacccgttcccggccggtacccggtaccgttccggtaccgtacccgacgggtaccgtacccgtaccggtccgggtacggacccgg

SEQ ID NO: 152413 - DNA, 833 bp, Homo sapiens
  misc_feature: GYAE6OF02GRE55.44.38.D05.1.454.CMB.1.raw
tcagacagtatatacacgaccggtgctcgatttagtatctgatagtggagtccgggggaggcttagttcagcctggggggtccctgagactctcctgtgcagcctctggattcaccttcagtagctactggatgcacgtgggtccgccaagctccgagggagggctggtgtgggtctcacgtattaatagtgatgggagtagcacaagctacgcggactccgtgaacgggccattccacatctccagagacaacgccaagacacgctgtatctgacaaatgaacagtctagagacgccgaggacacggctagtgttacttacgtgtacgacgaaggacggcccgggttggaccggggtaggtttaccggggggaagtttcggacgtaacgttacctttaaccgttaacgttaacggggttagttacggggtaccgtttaccgggttaggggggaacccgaaacgggggaaccccgtaccgggttaccgtaacccggtttcccgttaccccgtaccgtacggttacccgtttaccccgaaacccggtaaccggggtacccccgtaacgtttacccgggtttacccccgtttccccccggttacgggtccccggtccccgttccggtacccgttacccggtaaccgggtaccggtaccccgttacccggttacccgggttacgggggtaacccaccggtaaccgggtcccgggtaccccggttcggggggtcccgttccgggtacccggttaccgggttaacccggtaacccgggttaaccctttacccgttttaaccccgtttaagttaaccgtttacccgttcgtttacccgg

SEQ ID NO: 152414 - DNA, 349 bp, Homo sapiens
  misc_feature: GYAE6OF02JEKJE.44.38.D05.1.454.CMB.1.raw
  modified_base (325)..(328): a, c, t, g, unknown or other
  misc_feature (325)..(328): n is a, c, g, or t
  modified_base (330)..(349): a, c, t, g, unknown or other
  misc_feature (330)..(349): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaaggggaccacggtcaccgtctcctcagcttccaccaaggcccatcggtcttccccctggcgccctgcctccaggagcacctcgtgggggcacgagccggcccgtggggcctcggcctggtcaacggtactaccttccaacgtctacctgactgagcggctcggcaaggcgcatagnnnntnnnnnnnnnnnnnnnnnnnn

SEQ ID NO: 152415 - DNA, 946 bp, Homo sapiens
  misc_feature: GYAE6OF02I8DDM.44.38.D05.1.454.CMB.1.raw
  modified_base (146)..(146): a, c, t, g, unknown or other
  misc_feature (146)..(146): n is a, c, g, or t
tcagacagtatatacacgaccggtgctcgatttagtatctgatagtggagtccgggggaggcttagttcagcctgggggggtccctgagactctcctgtgcagcctctggattcaccttcagtagctactggatgcactgggtccncaagctccgagggaggggctggtgtggtctcacgtattaatagtgatgggagtagcacaagctacggcggtactccggtaggaacgggtccgattaccacctatcctccgaagaacgaccaacgaccaaagaaccaccgtctaggttaacttctacgaactaaacgtagtaaaccgtaggtacctagggaacggtaaccggacccggaaggggtaacctaccggggtcttaggttacggttaacttttaaccggaggttcggtaaccgtaaaaggggtaccggtacccggggtaggggtaccgggggttaacggggtttaccgggggggtaacgttacgggtaacctaaacgtttaacccgttaaacggtttaaacccggttaacggggttaacgttacggggaaacccggtttccggggttaaccgggggaaaccccggtaaaccgggggaacccccggtaccgggtttaacccggtaaacccccgggtttcccgttacccgttaacccggtaaccgttccccgtttaacccgaaaccccggggtaaacccggttacccgtaaacccggttcccgggtttaccccgttccccccgtcgggtccccgtacccggttaccgtaccgtaacccgtaacgggtcccggacctttaaccccgggtcgggtaccgggggaaccctacccgggtaacggcccccgggttaccggttaccgggtaccggttccggtaccggttaccgggtaccgtaaacggttaccctttaacgtttaacccgtaagttaccgttagtacggtacgg

SEQ ID NO: 152416 - DNA, 647 bp, Homo sapiens
  misc_feature: GYAE6OF02ITDJW.44.38.D05.1.454.CMB.1.raw
  modified_base (362)..(362): a, c, t, g, unknown or other
  misc_feature (362)..(362): n is a, c, g, or t
  modified_base (502)..(502): a, c, t, g, unknown or other
  misc_feature (502)..(502): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (599)..(599): a, c, t, g, unknown or other
  misc_feature (599)..(599): n is a, c, g, or t
  modified_base (622)..(622): a, c, t, g, unknown or other
  misc_feature (622)..(622): n is a, c, g, or t
  modified_base (630)..(630): a, c, t, g, unknown or other
  misc_feature (630)..(630): n is a, c, g, or t
  modified_base (637)..(637): a, c, t, g, unknown or other
  misc_feature (637)..(637): n is a, c, g, or t
tcagacagtatatacacgaccggtgctcgatttagtatctgatagtggagtccgggggagcttagttcagccgtggggggtccctgagactctcctgtgcagcctcgtggattcacctttcagtacgctactggatgcacgtggtccgcaagctccgaggggaagggcctggtacgtggtcctctacgtattaagtcggtgagtagggatcgaccaacggatccgtacgcggtaactccggtgaacgggtccctaagttccaccgatccgtcaaggacgaacaaccggcctaaagacctacgaccttggtaatcacgacaaagttcgacgtacgtctaggagacgcggacgtaccgtcggtntacggttacgtacttacgcggtaacgaacggtcggaccgtcgggtacggcggtttggggtaacgtcgttcgacttactacggtacctaggttcgtagcggaccgtaggcgaacgacgtcgaccggctccgtcgctacgtntaccggtaccacggtaacgctccgttacctcccgacgtccgaccgtnccgttaccncggacaccgtccgtacggtcggacgcgtacgccggtaccgngtccgagtccgcgtagaccggtntaacgtcncgttacncttgcgtacg

SEQ ID NO: 152417 - DNA, 608 bp, Homo sapiens
  misc_feature: GYAE6OF02GT1C5.44.38.D05.1.454.CMB.1.raw
  modified_base (176)..(176): a, c, t, g, unknown or other
  misc_feature (176)..(176): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
tcagacagtatatacacgaccggtgctcgatttagtatctgatagttggggtttggggcaccgaggacacggctgtgtattacgtgtgcaagagccggtgcgggagttcggggagttgcatactactactacggtatggacgtcgtggggccaagggaccacggtcaccgtctccncagtcttccaccgaaggccatccggtcttccccgtggccgccctgctccgaggngcaccgtcgtgggccacgngccggacctgggcctgccgtggtcgaaacggtcctacgttcctaagtactacctgtctaggacgcggactacggacgaaggcgtactagtagngacngagagtcntacgngtntcngntcgngtagcgtcagagacacaagcgtnaccgataagtctcggntacgctacgctagaagtgaacgtcaggtttanacgtagtactgtactacgtacgtacgtactacgtagtacgtagtacgtacgtacgtacgtacgtacgtacgtacggtacgtacgacgtacgtacgtaacgtacggtacggtacgtacggtacgtacgtacgtacgtaccgtaccgttacggtacgtacgtcgtccg

SEQ ID NO: 152418 - DNA, 267 bp, Homo sapiens
  misc_feature: GYAE6OF02GCOKQ.44.38.D05.1.454.CMB.1.raw
  modified_base (257)..(267): a, c, t, g, unknown or other
  misc_feature (257)..(267): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctgacgcccctgctccaggagcacctctgggggcacagcggccctgggctgcctggtcaaggactacttcctatatactgtctgagcgggctggcaggcgcatagnnnnnnnnnnn

SEQ ID NO: 152419 - DNA, 297 bp, Homo sapiens
  misc_feature: GYAE6OF02IN5JX.44.38.D05.1.454.CMB.1.raw
  modified_base (190)..(190): a, c, t, g, unknown or other
  misc_feature (190)..(190): n is a, c, g, or t
  modified_base (272)..(276): a, c, t, g, unknown or other
  misc_feature (272)..(276): n is a, c, g, or t
  modified_base (278)..(297): a, c, t, g, unknown or other
  misc_feature (278)..(297): n is a, c, g, or t
tcagacagtatatacacgaccggtgctcgatttagtatctgatagttgggtttgggggagttgcatactactactacggtatggacgtctggggccaagggaccacggtcaccgtctcctcagcttccaccaagggcccatcggtcttcccctggcgccctgctccaggagcacctcgtgggggccacgnggccggccctgggctcgccgtggtcaaggaccttacttcctatactactgtctgaggcgggcgtggcgaaggccgcagtagnnnnnannnnnnnnnnnnnnnnnnnn

SEQ ID NO: 152420 - DNA, 756 bp, Homo sapiens
  misc_feature: GYAE6OF02HEQ3K.44.38.D05.1.454.CMB.1.raw
  modified_base (273)..(273): a, c, t, g, unknown or other
  misc_feature (273)..(273): n is a, c, g, or t
  modified_base (406)..(406): a, c, t, g, unknown or other
  misc_feature (406)..(406): n is a, c, g, or t
tcagacagtatatacacgaccggtgctcgatttagtatctgatagttgggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggaggcgtcggccccagggtaggggggtccctggagacctctcctgtgcagcctntggattcaccttcgataattggaatatgcaggtgggtccgccaggcctccgagggcggaggggctgggacgtggggtggcgtaggtggtgtcatttcgaagtgggaagtaaaatcgaaacgttcgtaacggtntacgtttcccggttaggaacggggtaccctagttaccgaacctactaccgttacccgacgtaacggtaacctaaacgttaaccggtaaacgaaaccgtaaccgtaagttaccggttaccgttacctttaccgtaaaacgttacgtaaacctaacggtacccgttaacggaaaccgtacccgttaaccgaaccgggtaaccgtaaccgggtaccgttacgttttacgtttttacgttacggtaccggtaacgtaaccgttaacgttacccgtttaacggttttaacccgtaaaacgtttccggtttaaccgttaacgtttaccggtacccggtacccgggttacccggggg

SEQ ID NO: 152421 - DNA, 774 bp, Homo sapiens
  misc_feature: GYAE6OF02J19SG.44.38.D05.1.454.CMB.1.raw
  modified_base (184)..(184): a, c, t, g, unknown or other
  misc_feature (184)..(184): n is a, c, g, or t
  modified_base (289)..(289): a, c, t, g, unknown or other
  misc_feature (289)..(289): n is a, c, g, or t
tcagacagtatatacacgaccggtgctcgatttagtatctgatagttgggtttggggggaagaggaagactgacggtcctcccaggagttcaggtgctgggcaccgttgggcacgggggaggcttagtcagccgtgggggtccctgagactctctgtgcagcctctggacttcaccttcagtanctacgtgatgcaccgtcgggtccaccgaacgcctaccggaggggtaacgggcgtgggtggtcgggtctacgacgttagttaagtagtgaggtcgggagtagcaanaacgctacggcggtaccgttccggaggaacggccgtattacccaaccgtattaccgaaccgagaacggaacctaaccgaaccaagaaccctacgtaccgttaggtaaacttccgagtaaccaaaacgttgaaccgtgttaccggaaaggacgtaccgggacggtaacggacccgtagggtcctttaacggtcgtttaacgttacggttggaccgtaacggtaaacgggcccggggtacggttggggacgggttacgggttacgggtagttacggtacttacgttaacggtacgttacgaccggtaggtaccggttacgtcgggtacgggaccggtaacggtacccggcggttaccgtacgttcccgttacgaccgtacgtcccgtaacctaccggaaccggtcctccgttaccggttccccgtcggacccgtccgcccgtacgccgttaaccgcggtaaccgtcccgtcggtacgggtaccgccg

SEQ ID NO: 152422 - DNA, 308 bp, Homo sapiens
  misc_feature: GYAE6OF02HFU7X.44.38.D05.1.454.CMB.1.raw
  modified_base (275)..(275): a, c, t, g, unknown or other
  misc_feature (275)..(275): n is a, c, g, or t
  modified_base (277)..(308): a, c, t, g, unknown or other
  misc_feature (277)..(308): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccgaaggcccatcggtcttcccctggcgccctgctccaggagccacctcgtgggggcacgacgccggccctgggcctggcctggtaccgaaggaaccttacttcctatagtactgtctgaggcgggtctggacaaggcgactatagngnnnnnnnnnnnnnnnnnnnnnnnnnnnnnnnn

SEQ ID NO: 152423 - DNA, 263 bp, Homo sapiens; identical to SEQ ID NO: 152128
  misc_feature: GYAE6OF02FH9Q7.44.38.D05.1.454.CMB.1.raw
  modified_base (257)..(263): a, c, t, g, unknown or other
  misc_feature (257)..(263): n is a, c, g, or t

SEQ ID NO: 152424 - DNA, 774 bp, Homo sapiens
  misc_feature: GYAE6OF02F7PKI.44.38.D05.1.454.CMB.1.raw
  modified_base (380)..(380): a, c, t, g, unknown or other
  misc_feature (380)..(380): n is a, c, g, or t
  modified_base (733)..(733): a, c, t, g, unknown or other
  misc_feature (733)..(733): n is a, c, g, or t
tcagacagtatatacacgaccggtgctcgatttagtatctgatagttgggtttgggggaagaggaagactgacggtcctcccaggagttcaggtgctgggcaccttgggcacggggaggcttaggttcagccgtgggggggtccctggacgacgtcctccgtgtgcctagccctcgtgggactttcaacctttcaagtagctacgtggatgcacgtgggtccgcaagtcctcgagggaggctgggtcgtcgggtctacgacggttaattaagtcggtgagttagggactaggctacgaacgcgttacggccgtacgtccggtaggaacgggtccgacgttcaacctgtcctacgacgtacgactaaccgctaacggaacnccgacgtcgtaactctagtaccaaagtacggacacggtctacggacgtacgggaccggtaagaccggtacggtcggttacgttagtttaactaccggtttggacgtaccggtaaaacgtccgggacgggttaacggtaccggggttacgggttacggggtagttacggaccgtacgtaacccgttacgtacggttaaggtacgtcgggtacgttccgaggggtacccggtaaagggcccgtacggtccgtacccggtccgtttccgacgggtaccgttaccgtcccgaaccgtacgggacccgttacgtcccggttacccgttccccggacggcccggtacctaccgggtccnccggttaccggtacgcccttacccggcggggttagacccgg

SEQ ID NO: 152425 - DNA, 688 bp, Homo sapiens
  misc_feature: GYAE6OF02JHEYL.44.38.D05.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (385)..(385): a, c, t, g, unknown or other
  misc_feature (385)..(385): n is a, c, g, or t
tcagacagtatatacacgaccggtgctcgatttagtatctgatagtggagtccggggaggcttagttcagcctggggggtccctgagactctcctgtgcagcctctggattcaccttcagtagctactggatgcacgtggtccgaccaagctccgaagggaagggctggtgtgggtctacacgttattaatagtgatgggatacgcacaagctacgcggactccgngaacggccattcacatcncagacacaacgctaaagacacgctagtatcctagacaaagtcgaaacnggtctagagacgccgaaggacctacggctgtagtaactttacgtgtcgacaaaggcgccgggttaggacgggttacgttacgggtaggttacncttaacgttaactaccgtaaacgttacgggtagtccgggtaacgttcggtaccgggggaaccgaacgggtaacccgtaacggtaccgtaacccgtcctaccctcgaacgtccgttacccgacccgtaacggtacccgacggttacccggttcccgttccccgtcggtccctcccgttcgacccgtacgtacggtaccgtaccgtaccgttcggtacggggaccacggtaaccggccggtaccggtcgggtcgtcgtacgtcgtaaccgacgtaccgttacttacccgtatactacgtcgtacg

SEQ ID NO: 152426 - DNA, 269 bp, Homo sapiens
  misc_feature: GYAE6OF02H5TEZ.44.38.D05.1.454.CMB.1.raw
  modified_base (257)..(269): a, c, t, g, unknown or other
  misc_feature (257)..(269): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctcgtgggggcacagcggccctgggctgcctggtcaaggactacttcctatatactgtctgagcgggctggcaaggcgcatgnnnnnnnnnnnnn

SEQ ID NO: 152427 - DNA, 332 bp, Homo sapiens
  misc_feature: GYAE6OF02GCBOV.44.38.D05.1.454.CMB.1.raw
  modified_base (303)..(303): a, c, t, g, unknown or other
  misc_feature (303)..(303): n is a, c, g, or t
  modified_base (309)..(332): a, c, t, g, unknown or other
  misc_feature (309)..(332): n is a, c, g, or t
tcagacagtatatacacgaccggtgctcgatttagtatctgatagttgggtttgggcgaccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctgcgccctgctccaggagcacctctgggggcacagcggccctgggctgcctggtcaaggactacttccacgtctactgctgagcggctggcaaggcncatagnnnnnnnnnnnnnnnnnnnnnnnn

SEQ ID NO: 152428 - DNA, 372 bp, Homo sapiens
  misc_feature: GYAE6OF02GE905.44.38.D05.1.454.CMB.1.raw
  modified_base (221)..(221): a, c, t, g, unknown or other
  misc_feature (221)..(221): n is a, c, g, or t
  modified_base (336)..(372): a, c, t, g, unknown or other
  misc_feature (336)..(372): n is a, c, g, or t
tcagacagtatatacacgaccggtgctcgatttagtatctgatagttgggtttgggcaccgaggacacggctgtgtattactgtgcaagagccgggtgcgggagttcggggagttgcatactactactacggtatggacgtctggggccaagggaccacggtcaccgtctcctcagctccaccaacggcccatcggtctccccctggcgccctgctccagngcacctcgagagcacagccggcccgtgggctcgccgtggtacaacggacttacttccgtaataataactcgttctgaagggcgggcgttcgggacaaagggcgacctaataaggnnnnnnnnnnnnnnnnnnnnnnnnnnnnnnnnnnnnn

SEQ ID NO: 152429 - DNA, 734 bp, Homo sapiens
  misc_feature: GYAE6OF02JD3OC.44.38.D05.1.454.CMB.1.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (516)..(516): a, c, t, g, unknown or other
  misc_feature (516)..(516): n is a, c, g, or t
tcagacagtatatacacgaccggtgctcgatttagtatctgatagtggagtccgggggaggcttagttcagccgtggggggtccctgagactctcctgtgcagcctctggattcaccttcagtagctacgtggatgcgacgtcgggtcccgaccaagcctaccgaagggggaagggctgggtggtcggtctcgacgtaattaagtgtgagtgggtagtcgacaagaacgctaacggcgtacctcggtaggaacggtcctaattccacctatccgtaccgaagacgtaaccgaaccgacgtaaaanaaccgtacgtcttaagtaccttcaggaaacctaaagtacgtaaaccgngttccgtaagggaaacgccgggaccggaacgggaaccgtaccggtgtttagggttaagttcctttacgaggtcgaagtaaccggcggtccgggtagggaccggtttagggttcggaattcgaacgtaacttaccgaacgttacgaggttaggccggttacggnggacgggtacgaacggaccgacgtccgtacgtccgcgtcgtacgtcctaccgaccgacgtacccgtccgtccgttcccgtacccgtccgtcccgtccgccgtaccgaccgtaccgcgtaccgaccgttcggccggacgacgccgaccgtccgcggtccggcgtacccgtacgtaccggtaccgtacgtacccttacgtaccgtaccgtcgtccgtcgg

SEQ ID NO: 152430 - DNA, 790 bp, Homo sapiens
  misc_feature: GYAE6OF02IMBWE.44.38.D05.1.454.CMB.1.raw
  modified_base (214)..(214): a, c, t, g, unknown or other
  misc_feature (214)..(214): n is a, c, g, or t
tcagacagtatatacacgaccggtgctcgatttagtatctgatagtggagtccgggggaggcttagttcagccgtggggggtccctgagactctcctgtgcagcctctggatttcaccttcgagtagctactggatgcactgggtcccgccaagcctccgaggggagggctgggtgttgggtctcgaacgttattaagtagtgagtgggagtanacacgaagcgtacgccggacttccgaggacgggcctatccaaccgtatccgtaccaggacgaccgaacgaccgaaagaaccgtacgacgtacgttacgtcgtaacgacgaaacgtgaaactaggtaccgtaggcggaaccggaccggaacggaccgtaaccgggtcgtttaggttattttaacgtttaccgtgtagaaccgtaaggaccgggtaccgggtgggtacgggtagggttacggggtgttcgtaccaagtttacccgttagttaacggtaggttacgacggggtaccgttcgggacggggaccggtaaacgggtcccggtaccggtacccgtaccgttccgtaaccgtccgtacgtcccgtaacccgaaccgaaccggtcccgtaccgttccgttaccccgttcccgtccgccgtcccgtcgacccgtacgacgtacgccgtaccgttacggtccgggcaccgtaccggcccggtccggtaccgggtacccgtcccggtacggtaacccgtaccggttaacccgttacccgttaacggttaccgttaacggtccgttacggtagtacggg

SEQ ID NO: 152431 - DNA, 834 bp, Homo sapiens
  misc_feature: GYAE6OF02GDNMT.44.38.D05.1.454.CMB.1.raw
  modified_base (289)..(289): a, c, t, g, unknown or other
  misc_feature (289)..(289): n is a, c, g, or t
tcagacagtatatacacgaccggtgctcgatttagtatctgatagtggagtccggggagcttagttcagcctggggggtccctgagactctcctgtgcagcctctggattcaccttcagtagctactggatgcacgttgggtccgtccaagccgtaccgaggggaaagggtcttcggtggtgggttctcgtacgtaattaagtagttgagttgggtagtacgcaacgaagcctacgcgtacgtccgtaggacggcctattcaccactcctccgagagacaccgaccaanaacgacgtctacgtatctcgactaagtaggaacctagtacgtcggaagacggacggcggaacgaccggtcgtacgttagtactttagttcggtacgacgaacggacggtccggtaggggcgggttacggttagggggtacgtagtaccgtaaacttacgtaaccgttaccgggttaacggttaacgtaccgggccggttacgggtacgggacccgggtaacggaacccgggtaccgtacccgtaacccgttaccgtacccgaccgtaccgttcccgtacccgtaacccggaaccggttacccgaaccgttcccggttacccccgttaccccgtaccgtcccggtaccctccggtacccttaccggacggtaccggtccctaaccccgggttccgggtacgggacctaaccgggcggtacccgggttcccggtacggttaccggtacccggtacccggtttaaccgggtaacccgtaacccggtttacccgtttaaccggttaacccgttaacccgtttaaccgtttacggttccgttaacccggg

SEQ ID NO: 152432 - DNA, 275 bp, Homo sapiens
  misc_feature: GYAE6OF02F16UX.44.38.D05.1.454.CMB.1.raw
  modified_base (258)..(275): a, c, t, g, unknown or other
  misc_feature (258)..(275): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaagggcccatcggtcttccccctggcgccctgctccaggagcacctcgtgggggcacagcggccctgggctgccgtggtcaaggactacttcctatatactgtctgagcggctggacaggcgcatagnnnnnnnnnnnnnnnnnn

SEQ ID NO: 152433 - DNA, 725 bp, Homo sapiens
  misc_feature: GYAE6OF02GKJ93.44.38.D05.1.454.CMB.1.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
tcagacagtatatacacgaccggtgctcgatttagtatctgatagttggggtttggggggaagaggaagactgacggtcctcccaggagttcaggtgctgggcaccttgggcacgggggaggcttagttcagccgtggggggtccctgagactctcctgtgcagcctctggattcaccttcgagtagctacgtggatgccacgtgggtcccncaagctaccggaggggaagggctggtggtggtctcgacgtatatgngagtggagtagcaacagcctacggcgactccgtaggaacggtccnttaccgacctactcctacgagacgtaaccaaccgaccaaacggaacctcgtacttatacgtcngaactaagtacgaacctgttacgtaggaaggacgggtaccggaacggacggtccgttaggtggttacgttactcgtaggtacaagaacgggtcggtaccgggtgggtcggggtaacgggttgggtacgttcgactaacgttactaacgtacgttagggtacgtcggtacggtcggtcgggaacgtaacgggccggtaccgccgtacccgtccgtacgtaccgtcgttaccctaaccggacccggtaccgacccgttaccggtttccccggttccccggtccccggttccgggcccctcccgggttacctcccggtacgaccgggcccttaaccggtcccgggttgggaccccggtacgg

SEQ ID NO: 152434 - DNA, 835 bp, Homo sapiens
  misc_feature: GYAE6OF02JB4GM.44.38.D05.1.454.CMB.1.raw
  modified_base (132)..(132): a, c, t, g, unknown or other
  misc_feature (132)..(132): n is a, c, g, or t
tcagacagtatatacacgaccggtgctcgatttagtatctgatagtggagtccgggggagcttagtcagcctgggggtccctgagactctcctgtgcagcctctggattcaccttcagtagctactggatgncgtagggtccgccaaggctccgagggaagggctggtgtggtctcacgtattaatagtgatgggagtagcacaagctaacggcgtactccgtaggaacgggtccattcgaccattcctccgaaggacgaacaaccgaccaaagaaccgtaaccggccttagtacgttacctaggaaccctaaaggtcgaaaccgagttcctagacggaacgccggaacgggaccaacggtcttaggtacgtttaacttaccgtggtaccgaaccggtaaggacgggtccgggtaggtaccggggtaacgggttcggggaatttcggactaacgtttaacctttacgtaaccggttaacgttggtaccggtaccggttcggtccggggaacgtaaccgggtaacccgtaccgggttaccgtaaccccgggttcctacccggttaacgaccggttacccgttaacccgaacccgggtacccggttacccctacggtttacccggtccccgtttaacccccggtggtaccccgttacccgtaccgtaccgtacccggaacggttccgaacccgtacccggttcggggtacccggtaccgttaacggacccgggttcccgggacccgttagggggtaccctccgggttaccggttagggaacccttaaccggtacccgtttaccttaccggttacttaacgttcccgttaggtacccg

SEQ ID NO: 152435 - DNA, 669 bp, Homo sapiens
  misc_feature: GYAE6OF02IDWC8.44.38.D05.1.454.CMB.1.raw
  modified_base (280)..(280): a, c, t, g, unknown or other
  misc_feature (280)..(280): n is a, c, g, or t
  modified_base (361)..(361): a, c, t, g, unknown or other
  misc_feature (361)..(361): n is a, c, g, or t
tcagacagtatatacacgaccggtgctcgatttagtatctgatagttgggtttgggggaagaggaagactgacggtcctcccaggagttcaggtgctgggcaccttgggcacgggggaggcttagttcagccgtgggggtcctcgagactctcctgtgcacgcctcgtggtacgttctaccttcagtagcgtactggatgcgacgtcgggcccgccaacgctccgagggagggcgtggtggtggtctcgacgtattaatagtgagtggtaggagtcgaanaacggctaccggcggtaccgtcgaggaacgggccgtatcaccatccgtaccagacgtaacaccgaaccgaagaacgcgtcngttagtctacgaacaaaatgaaacgtacgtcgtagaggacgaccgacggtaacgcggtcgtcggttagttacttacgtggtacgacgtaacggcggcggtacgggtgggtacgggttcgggtaggttgagtactaacgttacgttaacgttaaggtagtcggtacggtgtcgggacggaacggaccgtaccggtctacccgtcgtccgtactcgtccgtaccgaccgaccggtccgtacgtccgtcccgttccccggtccggcccgtccgtccgccgtcgacggaccgcctaccgtccggtacggccg

SEQ ID NO: 152436 - DNA, 877 bp, Homo sapiens
  misc_feature: GYAE6OF02H9G3P.44.38.D05.1.454.CMB.1.raw
tcagacagtatatacacgaccggtgctcgatttagtatctgatagttgggtttggggggaagaggaagacctgacggtcctcccaggagttcaggtgctgggcaccgttcgggcaccgggggaggcttagttcgagtccgtggggggtccctgagactcgtcctgtgcagtcctcgtgattctaccttcgagtacgctacgtcgattcgctacgtcggtccgaccaagtctaccggaggggaacgggctaggtggtggtacctacgtaacgttagtttaagacgttagaggttagggacgtacacgaacgaacgtcgttaaccggtcggtaaccgttccggtagggaacgggaccgtaattaacccgaaccttaacgtacccgtaccgaacggaccgaaaccgaaacccggaaccccaaaagtaaacccgtaacgtcctttaacggttacaccggttacaaccgtaaaagtcggaaacctaccggttagacggaaccgacgggtacccgggaaggtacccgtacgggtagtttacggttagttaactttaccggtagggtccgaaagtttaacggacggtaccgggtagggtaccgggtaaacgggttttcggggaattacgtacgttaactaaccggtttaccggttaagtaaccggttacggttacggaccgggttccggttaacgggggacccgtaaacgggtaaccggttaccgtacgttcccccgtacgttaacccgacgtacctttcccgaaaccgaacccggtaaccggcccgttaccgttcccgggttccccgccccggttaggaccccgccccgtttaggcccttaaccggcgttaccggaccgttaccgggtaccgggcgtaacccg

SEQ ID NO: 152437 - DNA, 722 bp, Homo sapiens
  misc_feature: GYAE6OF02G4CBI.44.38.D05.1.454.CMB.1.raw
tcagacagtatatacacgaccggtgctcgatttagtatctgatagttgggtttgggggaagaggaagactgacggtcctcccaggagttcaggtgctgggcaccttgggcacgggggaggcttagttcagccgtggggggtccctgagactctcctgtgcagcctctggattcaccttcagtagctacgtggatgcacgtgggtccgccaagcctccgaggggaagggctgggtgtgggtctcgacgttattaagtagtgagttgggatagacacgaagcctacggccggtacgtccggtaaggaacgggccgtaattccaacccgtattccgacccgaaggaacgaaccgaaccgacccgaaaacgaaaccgtacggtccgtacgttacttccgtaaggaaccaaaagttcgaaactacggtcttaggaacgaacggacccggaaggaccgtaacgggctttagtacgttacgttaactgggtacaacgaacgggtacggtccgggtagggaccgggttagggttcgggagtcgactacgtactacgtacgtacgttagtcggtacgtcggtagggaccgaacgggaccgtacggtcctacccgtactccgtaccgtgacccgttccgaacggaccgtcctacgtcccggttccctcccggagggtcccctaccgtcgaccgtacgacggtaccgaccggttcccgtagggccgggtaacc

SEQ ID NO: 152438 - DNA, 277 bp, Homo sapiens
  misc_feature: GYAE6OF02FRJEN.44.38.D05.1.454.CMB.1.raw
  modified_base (258)..(277): a, c, t, g, unknown or other
  misc_feature (258)..(277): n is a, c, g, or t
tcagacagtatatacacgaccggtgctcgatttagtatctgatagttgggtttggggagttgcatactactactacggtatggacgtctggggccaagggaccacggtcaccgtctcctcagcttccaccaaggcccatcggtcttccccctggcgccctgctccaggagcacctcgtgggggcacagcggccctgggctgccgtggtcaaggactacttcctatatactgtctgagcgggctggcaaggcgcatagnnnnnnnnnnnnnnnnnnnn

SEQ ID NO: 152439 - DNA, 737 bp, Homo sapiens
  misc_feature: GYAE6OF02FP3KX.44.38.D05.1.454.CMB.1.raw
  modified_base (406)..(406): a, c, t, g, unknown or other
  misc_feature (406)..(406): n is a, c, g, or t
  modified_base (480)..(480): a, c, t, g, unknown or other
  misc_feature (480)..(480): n is a, c, g, or t
  modified_base (498)..(498): a, c, t, g, unknown or other
  misc_feature (498)..(498): n is a, c, g, or t
tcagacagtatatacacgaccggtgctcgatttagtatctgatagttgggtttggggggaagaggaagactgacggtcctcccaggagttcaggtgctgggcaccttgggcgacggggggaggcttagttcagccgtggggggtccctgagactcgtcctgtgcagcctcgtggtattcaccttcagtagctactggatgctacgtcgggtccgaccaacgcgtaccggaggggaacggggtctgggtggtcgggttacctcgaacgtttaattaagtaggtagtaggtggggtaacgtacgaccgacgaaggtaccgaccggtccggtacgttccggtaggaacgggtcctaagttccaacctacgtcctaccgagaaccgaacgaaaccgccgaaaacgaaccncggtacgttctaactcgaagtaacgaatacgaaactaggttccaggtaacgacggcggtaacggacctagggtnttacggtacttagttcgngtaccaggtacggcggtacgggtggtacgggggtacggtcgggtgtacgtactaacttacctagtaccgttaggaggtacggtacggtcgggtacggaccggtaaacggcccgtaacgggtccctacgtccgttacctcgttaccgccctacccggaacggaccgtaccttaccggtcccgtacccgtccggccgtacccgtcgtccgcgtacgcgtccgcgtcccggtggcccggacg

SEQ ID NO: 152440 - DNA, 809 bp, Homo sapiens
  misc_feature: GYAE6OF02JAWFS.44.38.D05.1.454.CMB.1.raw
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
tcagacagtatatacacgaccggtgctcgatttagtatctgatagtggagtccggggggaggcttagttcagcctgggggggtccctgagactctcctgtgcagcctctggattcaccttcagtagctacgtggatcgcacgtgggtccgccaagctccgaggggaagggtctggtgtgggtctcacgtattaatagtgagtggggagtagacacaagcgtacgcggaccgttccggtaggaacgggtccgtattacccacctactctaccaagacacaacgaccaaggaacacgtctagttactctanaacaaagtcgaaacttacggttacagggaacggcggaccgggaacggtaccgggccgggtacttgggttaacgtttatttaacggnggttacgaagtaaggccggtccggggtaagggcccgggggttaaggggtttccgggggagtttaccgaaccgtaacttttacccggaacgttaaccggttagggagttcgggacgttacgggtacggggacgaaccgggtacgtacccggttaccgtacccggtcgtacccgtacgtccgtaccgttacccaacccggtaccgggtacccgtaccggttccccgggttaccccgttccccgtccgggtacccgtccccgtacggtaccccgtccgggaacggtcccgtaccgccgggttaaccggccgggtaccgaccggtacccggccgggtcccggtcggtccgtcccggacggttcgggtaaccgtaccggttaccttactttacccgtaagttacgttacgttcgtcggg

SEQ ID NO: 152441 - DNA, 357 bp, Homo sapiens
  misc_feature: GYAE6OF02JIX2Z.44.38.D05.1.454.CMB.1.raw
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (315)..(357): a, c, t, g, unknown or other
  misc_feature (315)..(357): n is a, c, g, or t
tcagacagtatatacacgaccggtgctcgatttagtatctgatagttgggtttgggcaccgaggacacggctgtgtattactgtgcaagagccggtgcgggagttcggggagttgcatactactactacggtatggacgtctggggccaagggaccacggtcaccgtctcctcagcttccaccaaggcccatcggtcttccccctggcgccctgcctccaggagccacctctgggggcacngcggccctggctcgcctggtcaaggctactcctatatactgtcngtagcggctggtacgaggcacgtatacggnnnnnnnnnnnnnnnnnnnnnnnnnnnnnnnnnnnnnnnnnnn

SEQ ID NO: 152442 - DNA, 173 bp, Homo sapiens
  misc_feature: GYAE6OF01DYSWI.1.12.B01.1.454.CMB.1.raw
  modified_base (157)..(173): a, c, t, g, unknown or other
  misc_feature (157)..(173): n is a, c, g, or t
tcagacgagtgcgtcacgaccggtgctcgatttagtagtgtagatttagggtttggggggaagaggaagactgacggtcctgccacagcggccctgggctgcctggtcaaggactacttccagtactctatctgagcgggctggcaaggcgcatagnnnnnnnnnnnnnnnnn

SEQ ID NO: 152443 - DNA, 171 bp, Homo sapiens
  misc_feature: GYAE6OF02F8CFR.1.12.B01.1.454.CMB.1.raw
  modified_base (164)..(171): a, c, t, g, unknown or other
  misc_feature (164)..(171): n is a, c, g, or t
tcagacgagtgcgtcacgaccggtgctcgatttagtagtgtagatttgggttcggggaagtagtccctgctccaggagcacctccgagagcacagcggccctgggctgcctggtcaaggactacttccacgcactcgtctgagcgggctggcaaggcgcatagnnnnnnnn

SEQ ID NO: 152444 - DNA, 547 bp, Homo sapiens
  misc_feature: GYAE6OF02G3IUD.1.12.B01.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (495)..(495): a, c, t, g, unknown or other
  misc_feature (495)..(495): n is a, c, g, or t
tcagacgagtgcgtcacgaccggtgctcgatttagtagtgtagatttagggtttggggggacatgagggtccccgctcagctcctggggctcctgctgctctggttcccaggttccagatgcgacatccagatgacccagtctccatcttccgtgtctgcatctattggagacaggacgtcaccatccacttcgcccgggcgagtcaggccatcagcgtattctttagcctggttcncagcagaaaccngggacgagcccctcagatcgtagtctagtggtgcatccagattgactaagggtgggtcccagtccaggttcagtggcagtgcatcgtggacagtattacactntcatatcagcagtccctgacagcctagaagtacttttagacttaaattttatactacgtactaaactagttattactaccgtaccctagtcgggtacgttccggcgaaggggacctaaagggtcggaataccgaaacgactgngtctgaccactatctcgttacttcacgttcctcccgctacgtcgtagtaccg

SEQ ID NO: 152445 - DNA, 386 bp, Homo sapiens
  misc_feature: GYAE6OF01A6U0U.7.20.B09.1.454.CMB.1.raw
  modified_base (247)..(247): a, c, t, g, unknown or other
  misc_feature (247)..(247): n is a, c, g, or t
  modified_base (333)..(333): a, c, t, g, unknown or other
  misc_feature (333)..(333): n is a, c, g, or t
  modified_base (370)..(386): a, c, t, g, unknown or other
  misc_feature (370)..(386): n is a, c, g, or t
tcagcgtgtctctacacgaccggtgctcgatttagtgtagtgtgaagggccgattcaccgtctccagagacaacaccaagaattcacttttctggaaatggacaccctgagagccgaagacacggctgttactactgtgtgcgcgaatgggccacgtggagacagaagacacttttgacaaatggggccagggaaccctggtcaccgtctcctcagcactccccgacagccccaaggtccttcccgntcgacgcctctgcagccacccagcccagactggggaacgtggtcagtccgcctggcccttggtccaagggaccttacttcctaagngactacgcctggacgcgggctggcaaggcgcagtagnnnnnnnnnnnnnnnnn

SEQ ID NO: 152446 - DNA, 453 bp, Homo sapiens
  misc_feature: GYAE6OF02IHF53.7.20.B09.1.454.CMB.1.raw
  modified_base (255)..(255): a, c, t, g, unknown or other
  misc_feature (255)..(255): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (397)..(453): a, c, t, g, unknown or other
  misc_feature (397)..(453): n is a, c, g, or t
tcagcgtgtctctacacgaccggtgctcgatttagtgtagtgtgaagggccggtaggttcaccgtctccagagacaacaccaagaattcactttttctggaaatggacaccctggagagccgaagacacggctgtttactactgtgtgcgcgaatggggccacggtggagacagaagacactttttgacaaatggggcccagggaaccctggtcaccgtctcctcagcatccccgacagcccaaggtcttcccgntgagcctctgcagtccaccagtccagacttcggggaacgtcggtacacgtccgccgttcgcctcgggtccaaaagggtacctaacttccgtaagagtacacgtcctagagcgggctgggacaagggtccnagtagnanagcnnnnnnnnnnnnnnnnnnnnnnnnnnnnnnnnnnnnnnnnnnnnnnnnnnnnnnnnn

SEQ ID NO: 152447 - DNA, 123 bp, Homo sapiens
  misc_feature: GYAE6OF01EAD4F.13.53.E09.1.454.CMB.1.raw
tcagtcacgtactacacgaccggtgctcgatttagagagagtgtgttgggttgggctgcaccatctgtcttcatcttccgccatctgatagtacgtgactgagcgggctggcaaggcgcatag

SEQ ID NO: 152448 - DNA, 172 bp, Homo sapiens
  misc_feature: GYAE6OF01D9IVG.13.53.E09.1.454.CMB.1.raw
  modified_base (172)..(172): a, c, t, g, unknown or other
  misc_feature (172)..(172): n is a, c, g, or t
tcagtcacgtactacacgaccggtgctcgatttagagagagtgtgttgggtttggggaagaggaagactgacggtcccccaggagttcaggtgctgggcacagcggccctgggctgcctggtcaaggactacttcctagtacgtgactgagcgggctggcaaggcgcatagn

SEQ ID NO: 152449 - DNA, 131 bp, Homo sapiens
  misc_feature: GYAE6OF01EAEZM.13.53.E09.1.454.CMB.1.raw
  modified_base (127)..(131): a, c, t, g, unknown or other
  misc_feature (127)..(131): n is a, c, g, or t
tcagtcacgtactacacgaccggtgctcgatttagagagagtgtgttgggtttggggctgcaccatctgtcttcatcttcccgccatctgatagtacgtgactgagcgggctggcaaggcgcatagnnnnn

SEQ ID NO: 152450 - DNA, 172 bp, Homo sapiens; identical to SEQ ID NO: 152448
  misc_feature: GYAE6OF01CXIIF.13.53.E09.1.454.CMB.1.raw
  modified_base (172)..(172): a, c, t, g, unknown or other
  misc_feature (172)..(172): n is a, c, g, or t

SEQ ID NO: 152451 - DNA, 513 bp, Homo sapiens
  misc_feature: GYAE6OF01AKCPV.13.53.E09.1.454.CMB.1.raw
  modified_base (481)..(481): a, c, t, g, unknown or other
  misc_feature (481)..(481): n is a, c, g, or t
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtgggatcccatcaaggttcagtggcagtagatctggaacagattttaccctcaccatcagggtctacagcctgaagattttgcgacttactattgtcaacagagttaccttctcccccggacgttcgtccaacggaccaacggtggaaatcgaagacgaactagtcggntgcaccatctcgttcttcacttcttcccgtcc

SEQ ID NO: 152452 - DNA, 603 bp, Homo sapiens
  misc_feature: GYAE6OF01CC24Y.13.53.E09.1.454.CMB.1.raw
  modified_base (365)..(365): a, c, t, g, unknown or other
  misc_feature (365)..(365): n is a, c, g, or t
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttacccncacatcagggtctacagcctgaagtatttgcgtacttactattgtacaaacagtaacgttacccttctcccccggacgttccgaccgtaaagggacccgaaacgggtacggaaaacgttacgaaacgaccggtaaacgtacggttacgggaccgttacggccgtaaaccccgtaacgtttacccgttacgggtttaccttttaccctaactttcccgttttcccccggttaacccccg

SEQ ID NO: 152453 - DNA, 174 bp, Homo sapiens
  misc_feature: GYAE6OF01EWRV3.13.53.E09.1.454.CMB.1.raw
  modified_base (173)..(174): a, c, t, g, unknown or other
  misc_feature (173)..(174): n is a, c, g, or t
tcagtcacgtactacacgaccggtgctcgatttagagagagtgtgttgggtttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 152454 - DNA, 127 bp, Homo sapiens
  misc_feature: GYAE6OF01C7LOY.13.53.E09.1.454.CMB.1.raw
  modified_base (127)..(127): a, c, t, g, unknown or other
  misc_feature (127)..(127): n is a, c, g, or t
tcagtcacgtactacacgaccggtgctcgatttagagagagtgtgttgggtttggggctgcaccatctgtcttcatcttcccgccatctgatagtacgtgactgagcgggctggcaaggcgcatagn

SEQ ID NO: 152455 - DNA, 186 bp, Homo sapiens
  misc_feature: GYAE6OF01BIH1E.13.53.E09.1.454.CMB.1.raw
  modified_base (174)..(186): a, c, t, g, unknown or other
  misc_feature (174)..(186): n is a, c, g, or t
tcagtcacgtactacacgaccggtgctcgatttagagagagtgtgttgggtttggggggaagaggaagactgacggtcccccaggagttcaggtgctgggcacagcggccctgggctgcctggtcaaggactacttcctagtacgtgactgagcgggctggcaaggcgcatagnnnnnnnnnnnnn

SEQ ID NO: 152456 - DNA, 567 bp, Homo sapiens
  misc_feature: GYAE6OF01EHM93.13.53.E09.1.454.CMB.1.raw
  modified_base (403)..(403): a, c, t, g, unknown or other
  misc_feature (403)..(403): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactactttaaattggtatcagcagaagtcagggcaacgccccgaacctcctgatctacgtacactccactttgcacagtggactccatacaagttcagtgacagtagatcgtagaactagtacttttaccactacatcgagggtctacgagtcctagtaagtnttttgacgttacttactatttgtacaaacgtacgtaacgttacccttcccgtacccccggtacggttccgtaccgtaacgggaaccgaacggtaggaactaacgaacgtacgaacgtggtcgtagcgtacgacctatctcgtcttactcttccgtcccgtaccg

SEQ ID NO: 152457 - DNA, 515 bp, Homo sapiens
  misc_feature: GYAE6OF01CXFZH.13.53.E09.1.454.CMB.1.raw
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtgggatccatcaaggttcagtggcagtagatcnggaacagattttacccncaccatcagggtctacagcctagaagtatttgcgtactttactattgtactaacagtacgtttacccttctacccccggtacgtttcggaccaagggaccaaggtgaaatcaagcgaactgtggctgcacatctgtcttcactctcccgtcc

SEQ ID NO: 152458 - DNA, 499 bp, Homo sapiens
  misc_feature: GYAE6OF01COGSQ.13.53.E09.1.454.CMB.1.raw
  modified_base (360)..(360): a, c, t, g, unknown or other
  misc_feature (360)..(360): n is a, c, g, or t
  modified_base (471)..(471): a, c, t, g, unknown or other
  misc_feature (471)..(471): n is a, c, g, or t
  modified_base (486)..(486): a, c, t, g, unknown or other
  misc_feature (486)..(486): n is a, c, g, or t
tcagtcacgtactacacgaccggtgctcgatttagagagagtgtgttgggtttgggggagtcagtctcagtcaggacacagcatggacatgagggtccccgctcagctcctgggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatccatcaaggttcagtgcagtagatctggaacagattttacccncaccatcagggtctacagcctgaagtattttgcgacttactattgtcaacagagttaccttctccccggacgttcgccaaggaccaaggtgaaatcaagcgaactgtaggntgcacatctgtactnactcttcccgtcc

SEQ ID NO: 152459 - DNA, 127 bp, Homo sapiens; identical to SEQ ID NO: 152454
  misc_feature: GYAE6OF01AI00U.13.53.E09.1.454.CMB.1.raw
  modified_base (127)..(127): a, c, t, g, unknown or other
  misc_feature (127)..(127): n is a, c, g, or t

SEQ ID NO: 152460 - DNA, 569 bp, Homo sapiens
  misc_feature: GYAE6OF01DX3U8.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaacctcctgatctacggtacatccactttgcacgagtgggactcccatacgaaggttcagtggacagtagatcgtagaactagtactttaccctcacctagtcgtagggtctacgagtcctagaagtatttacgcgttaacctttacttatttcgtactaacgtagtaccgtttacccgttcccgtacccccgggtacgttaccggaccgtaaacgggaccaagggtagaaagtcgaaagcgaatggtcgtctgcacctatcgtgttcttactcttccgttcccgtcc

SEQ ID NO: 152461 - DNA, 175 bp, Homo sapiens
  misc_feature: GYAE6OF01CLGF6.13.53.E09.1.454.CMB.1.raw
  modified_base (173)..(175): a, c, t, g, unknown or other
  misc_feature (173)..(175): n is a, c, g, or t
tcagtcacgtactacacgaccggtgctcgatttagagagagtgtgttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 152462 - DNA, 533 bp, Homo sapiens
  misc_feature: GYAE6OF01DQTI8.13.53.E09.1.454.CMB.1.raw
  modified_base (367)..(367): a, c, t, g, unknown or other
  misc_feature (367)..(367): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtgcagtagatctggaacagtacttttacccncaccatcaggggtctacagcctgaagtatttgcgtactttactatttgtactaacagtacgtttaccttctcccccggtacgtttccggaccgtaacgggacctaaggtcggaaagtcgaagcgaacgtggtcggntgcaccatctcgtcttcnctcttcccgtcc

SEQ ID NO: 152463 - DNA, 376 bp, Homo sapiens
  misc_feature: GYAE6OF01CJQIH.13.53.E09.1.454.CMB.1.raw
  modified_base (370)..(376): a, c, t, g, unknown or other
  misc_feature (370)..(376): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagagggctccacaacaccccggtattctgtctgccctctctccacccccttccctgtccacacaggtcagcccaaggcccaaccccactcgtccactctcgttccccgccctccctctagtacgtgactgacgcgggctggcaaggcgcatagnnnnnnn

SEQ ID NO: 152464 - DNA, 536 bp, Homo sapiens
  misc_feature: GYAE6OF01DWI1Q.13.53.E09.1.454.CMB.1.raw
  modified_base (500)..(500): a, c, t, g, unknown or other
  misc_feature (500)..(500): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccgccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatccatcaaggttcagtggcagtagatctggaacagtacttttaccctcaccatctagggtctacagcctagaagtatttgcgtacttactattgtacaactagacgtttaccttccgtcccccggtacgttccggtccgaacgggacccaaggtcgaaacgttcaagccgaacgtgtcggntggcaccatccttgttcttctacttcttcccgtacc

SEQ ID NO: 152465 - DNA, 173 bp, Homo sapiens
  misc_feature: GYAE6OF01EVSA9.13.53.E09.1.454.CMB.1.raw
  modified_base (173)..(173): a, c, t, g, unknown or other
  misc_feature (173)..(173): n is a, c, g, or t
tcagtcacgtactacacgaccggtgctcgatttagagagagtgtgttgggtttgggggaagaggaagactgacggtcccccaggagttcaggtgctgggcacagcggccctgggctgcctggtcaaggactacttcctagtacgtgactgagcgggctggcaaggcgcatagn

SEQ ID NO: 152466 - DNA, 519 bp, Homo sapiens
  misc_feature: GYAE6OF01EZKA0.13.53.E09.1.454.CMB.1.raw
  modified_base (393)..(393): a, c, t, g, unknown or other
  misc_feature (393)..(393): n is a, c, g, or t
  modified_base (515)..(515): a, c, t, g, unknown or other
  misc_feature (515)..(515): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggccagtcaggacattaacagttatttagtctggtatcagcaaaaaccagggaaatccctaagctcctgatctatgttgcatccactttgcaaagtgggtcccatcaaggttcagcggcagtggatctgggacagaattcactctcacaatcagcagcctgcagcctagaagtnttttgacttaactttattactgtacaacagtacttaaattacgttacccgcttacaggtttcggacggtagggacctaaagggtggaagataccgaaaacgacgtggtcggctagcctaccnttcg

SEQ ID NO: 152467 - DNA, 173 bp, Homo sapiens; identical to SEQ ID NO: 152465
  misc_feature: GYAE6OF01C2ISA.13.53.E09.1.454.CMB.1.raw
  modified_base (173)..(173): a, c, t, g, unknown or other
  misc_feature (173)..(173): n is a, c, g, or t

SEQ ID NO: 152468 - DNA, 581 bp, Homo sapiens
  misc_feature: GYAE6OF01C7GXP.13.53.E09.1.454.CMB.1.raw
tcagtcacgtactacacgaccggtgctcgatttagagagagtgtgttgggtttgggggagtcagtctcagtcaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcagacaattaacaattaattaaattgtatcagcaagaaacaaggtaaacgcccctaagcctacctagtactactacgatgacatacctaagtttacggaaaacgtcggggtaccctagtaacgtaaggttcaggtaggaaggtggatcgtgggtaactagttaacttttactttaccactatcgagcagctgacagctagaagtactagttacgacaaacttataactttactgtacagtactagttaatagtaataactccgtaccgtactacccgtaccgttaccgggaccctaaagggacctaccggtaaggacgaaaggtaaacttaaacgtaagtcggttcggctaccgg

SEQ ID NO: 152469 - DNA, 570 bp, Homo sapiens
  misc_feature: GYAE6OF01DXN0X.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggcaacttctttaaattggtatcagcagaagtcagggcaacgccccgaacctcctgactctacggtacatcctactttgcacagtggactccatcaaggttcagtgcagtagatcgtaggaacagtacttttacccactaccatcgagggtactacgagtcctagaagtatttcgacgtactttactatttacgtactaacgacgttacgttacccttccgtacccccgggtacgttccgggtaccgtaaacgggtacctaagggtacggaaactcgaagaccgaacgtcggtacgctggccaccatcgtgttcttacacttccttcccgtacc

SEQ ID NO: 152470 - DNA, 542 bp, Homo sapiens
  misc_feature: GYAE6OF01ATGE3.13.53.E09.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactcctgatctacggtacatccactttgcacagtggatcccatcaagttcagtgcagtanatctggaacagtattttacccncaccatcagggtctacgagcctgaagtntttgacgtacttactattgacaactagtacgtttaccttccgtacccccggtagttccgaccgaacgggtaccaagggtagaaacgtcgaagacgaacgtgtcggctagccacctataccgttcgttacttactacttccgttcccgtaccc

SEQ ID NO: 152471 - DNA, 528 bp, Homo sapiens
  misc_feature: GYAE6OF01BEJTQ.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcctccctgtctgcatctgtaggagacagagtcaccatcacttgccgggcaagtcagggcattagaaatgatttaggctggtatcagcagaaaccagggaaagtccctaagctcttgatctatggtgcatccagtttaaaaagtgggtacccatcaaggttcagcggcagtggatctggcacagacttcattctcaccatcagcagcctgcagcctagaagtattttgactaactttattactgtactacaagtactacaactaattactccgtagggtaccgttcggaccgaaagggaccgtaagggtaggaaactaccgaaaacgaacgttaggtacggatacgcctacctacg

SEQ ID NO: 152472 - DNA, 541 bp, Homo sapiens
  misc_feature: GYAE6OF01B4595.13.53.E09.1.454.CMB.1.raw
  modified_base (366)..(366): a, c, t, g, unknown or other
  misc_feature (366)..(366): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatcaaggttcagtggcagtagatcgtggaacagtacttttacccncaccatcgagggtctacagcctagaagtattttgcgtacttactattgtacaactagtacgtttaccttccgtacccccggtacgttccggtaccgaacgggaccgaaggtacggaaactacgaacgacgaacgtggtcggntacgcaccatctcgtcttcnctccttcccgtcc

SEQ ID NO: 152473 - DNA, 541 bp, Homo sapiens
  misc_feature: GYAE6OF01DXUN1.13.53.E09.1.454.CMB.1.raw
  modified_base (456)..(456): a, c, t, g, unknown or other
  misc_feature (456)..(456): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgccgggccagtcaggacattaacagttatttagtctggtatcagacaaaaaccgagggaaactccctaagctcctgatctatgttgcatccacttttgactaaaggtggggtacccatcgaaggttcagcggcagtggatcgtgggaacagaattcactctacacaatcagcagcctgcagcctagaatattttgactaactttattactgtacaactagtactttaatacgttaccccgnttcgtaggtttcgggacggtaagggaccgtaagggtggaagtaagtacaaacggtactggtaggactgaccactatcttgttacc

SEQ ID NO: 152474 - DNA, 381 bp, Homo sapiens
  misc_feature: GYAE6OF01CTG1O.13.53.E09.1.454.CMB.1.raw
  modified_base (374)..(381): a, c, t, g, unknown or other
  misc_feature (374)..(381): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaacccgggtggaccggatggccacactgtgaacccctcccagagactttagacagagagagggctccacaacaccccggtattctgtctcgccctctcctccacccccttccctgtcccacacaggtcacgcccaacggccaacccactcgtcactctcgttccccgccctcctctagtaccgtgactgacgcgggcgtggcgaaggcgcatagnnnnnnnn

SEQ ID NO: 152475 - DNA, 575 bp, Homo sapiens
  misc_feature: GYAE6OF01CCYQH.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggcaactctttaaattggtatcagcagaagtcaggcaacgcccgaactcctgatctacggtacagtcctactttgcacaggtcggactccaatcaaggttcagtggcagtagatcgtaggaacagtacttttacccacgtaccatcgacggggtctaacacgctagtaagtattttgacgtactttactagttagtacaactagtacgttaccttccgtacccccggtaggttccggtccgaaacgggtaccgaacggtacgaaagtactaacggacgtaacgtagtacggtctacgcaccgtataccgtcttaccgttactacttccttcccgtacccg

SEQ ID NO: 152476 - DNA, 650 bp, Homo sapiens
  misc_feature: GYAE6OF01COH9M.13.53.E09.1.454.CMB.1.raw
  modified_base (353)..(353): a, c, t, g, unknown or other
  misc_feature (353)..(353): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagaacagttggacaactctttaaattggtatcagcagagtcagggcaagccccgaacctcctagactctaacggtacatcctactttgcacagtggactcccatacaaggttcagtggacagtanagtcgtaggaactagtacttttacccgctaccagtacgtaaggggttcctaacgacgtaccctaggtaaagttacgttttagaccggttaactttacgttaacgttagtaaccgtaaactaaggtaaccgttttaaccctttcccgtacccccgggtaccgttacgggtacccgtaaacgggacccgtaaacgggtggaaaacttacgaaacggtaccggtaaaccgttagggtcggtacgacggtaccacccgtacttacgttacttacttacctacttcccgtttccgtaccccg

SEQ ID NO: 152477 - DNA, 732 bp, Homo sapiens
  misc_feature: GYAE6OF01CUL3S.13.53.E09.1.454.CMB.1.raw
tcagtcacgtactacacgaccggtgctcgatttagagagagtgtgttgggtttgggggagtcagtctcagtcaggacacagcatggacatgagggtccctgctcagctcctgggactcctgctgctctggctcccagataccagatgtgacatccagatgacccagtctccatccctccctgtctgcatctcttggagacagagtccaccgtcacgttcgccgggcagtcacgacaattaactacttatttacgcctaggtatcagcagaacgccgagggagacgtaccctaaaattattgatctctgcgtgccgtccgtccttcgcgtaacggttccggggtcctagttccgttcggttccagggttcggacgggtggtacgtacggtaaggactaagtaacttctactctacctacctaactaccaaaccctaacctcggacctaacccgtagaaacgtacgttgggtttaacggtaaacgtttaacgtttaacgttcgtaacgtaacgttaaccgttaaggttacggttacggggttcccgggtaccccgttaccgttaccgtttacgggtttttacccggggaccgggggttaaaccggggtaaacccgggttaacggggtacggtaaccgggtaaacgtaaaccggttaacccggtaaaaaaccgggtaacccgtttagggtaccgggtaccgtttacccggaaccctaccgttaccgtttacccgg

SEQ ID NO: 152478 - DNA, 369 bp, Homo sapiens
  misc_feature: GYAE6OF01CYCF5.13.53.E09.1.454.CMB.1.raw
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
  modified_base (363)..(369): a, c, t, g, unknown or other
  misc_feature (363)..(369): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggataggggaaagaagaggagagaaccccgggtggaccggatggccacactgtgaaccctccagagactttagacagagagagggcncanaacacccggtattctgtctgccctctctccaccccttccntccacaacnggtcacgccaacggccaaacccactgtccactctcgttcccactctcctctagtactgactgagcgggctaggcaaggcactanagnnnnnnn

SEQ ID NO: 152479 - DNA, 680 bp, Homo sapiens
  misc_feature: GYAE6OF01ADJ0N.13.53.E09.1.454.CMB.1.raw
  modified_base (627)..(627): a, c, t, g, unknown or other
  misc_feature (627)..(627): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgccgtctcgtcggagaccgagggtccaaccactctacttggtccgggacaagtcaagaacagttaggacctaacttactttaattggtactcgagcaagaacgtcgacggaccaaccgacccccgtaactccgtagactaccgtaccggtaccactccctactttcgactacgtaggtacggtactaccctagtacgtaaggttccgaggtcgacgtaagtagtactacgtaacggaaccttacgtaccttttaaccccactaaccgtagtcggtaaccgggtcctaacgacgttaccgtaaggttaacgttacgttttacggaacctttacgtttaactacgttacgtacaacgtacgttacgttacccttcccgtacccggtacgtcgaccgtaacggacgtacgtacgaagtacgacggtacgtacggtcgtcggtacncggcctaaccgtacttaccgtcttaccttacctaccttcccggcccgttaccg

SEQ ID NO: 152480 - DNA, 649 bp, Homo sapiens
  misc_feature: GYAE6OF01E18K4.13.53.E09.1.454.CMB.1.raw
  modified_base (373)..(373): a, c, t, g, unknown or other
  misc_feature (373)..(373): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaacgccccgaacctcctgatctacggtacactccactttgcacagtgggactcccatcaaggttcagtggcagtagatcgtaggaactagtacttttacccncacctatcgagggtctacacgtctagaagtgttttcgacgtacttacttagtttacgtacctaaactacggtaaccttttacccttaccccgttaccccccgggtaaccggtttccggtaacccggtaacgggtaaacccgtaacgggttaacgggtaaaacgtaccgtaaacggtaaccgtaacggttacggttacgggtacgtacggtaccctaacccgttaactacccgttacgttaccctttaccgtaccttcccgttcccccggtaacccg

SEQ ID NO: 152481 - DNA, 557 bp, Homo sapiens
  misc_feature: GYAE6OF01B7S19.13.53.E09.1.454.CMB.1.raw
  modified_base (366)..(366): a, c, t, g, unknown or other
  misc_feature (366)..(366): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatccatcaaggttcagtgcagtagatctaggaacagtacttttacccncacctatcgaggggtctacgagcctagaagtatttcgacgtactttactattcgtactaacgtagtacgtttaccttccgtcccccggtacgttccggaccgtaacgggaccgaacgggtaggaaacgtacgaacgacgtaacgtgtcggcgtacgcacctatcgtctcttactcttccgttcccgtaccc

SEQ ID NO: 152482 - DNA, 537 bp, Homo sapiens
  misc_feature: GYAE6OF01DBGHK.13.53.E09.1.454.CMB.1.raw
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctgctctggctctcaggtgccagatgtgacatccagatgacccagtctccatcctccctgtctgcatctgtaggagacagagtcacatcacttgccgggcaagtcagggcattagaaatgattaggctggtatcagcaagaaaccgagggaaacgcccctaagctcgtgatctatggtgctatacctaagtttaaaaggtgggtaccatacgaaggttcagcggacagtggatcgtggacanagtacttcacttcnccacancagtcacgcctgctacgcctagaacgttnttttgactaactttattactacgtactaacgaagtactactaactattactaccgttagggaccgttacggaccgtaaagggacgaagggtacgaaagtacgaaacgtactagtagctgctaacg

SEQ ID NO: 152483 - DNA, 621 bp, Homo sapiens
  misc_feature: GYAE6OF01BZNBU.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtcaccatcacttgtcggcaagtcagaacattggactaacttctttaaattggtatcagcagaagtcgaggcaacgccccaactctgatctacgtacactcctacttgcacgtaggtaggactcccatcgaaggttcagtggacagtagatcgtaggaactagtactttacccacacctatcgtacgggtctacgagtcctagtaagttatttcggactaactttacgtacttgtaccaactacgtacgtttacccgttcctacccccgggtagttcccggaccgtaacgggtaaccggaagggttaaggtaaacgtaacgaacggtacgtaaacggttggtacggtctaccggtccaccgttaagttaccgttcggttaccctttacccgtaaacgtttcccttacccccggtacc

SEQ ID NO: 152484 - DNA, 709 bp, Homo sapiens
  misc_feature: GYAE6OF01CAQLH.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctccgtggggctcctgctactctggctccggaggtgccagatgtgacatccagatgagccagtcctccatcccacctgtctgcgtctcgtcggagacgagggtccacctatcctacgttggtaccgggactaagtacaaggaactagttacggacttaaacttacttttaaaagttggtatcgaagacaaggtaacgtacgaacggggaccaacggacccccgtaactcctagtactacgtacggtactactcctagtttcgacacgtaggtacggtactaccgtatacgtaaggtcaaggtggactagtagatacgtaggtaactagttacctttaccgactacacgtacgtacggtacgtacgtacgtacgtagtaacgttagtttacgtacgtactttaacttacgttacgtaactaacgtaacgttaccgtttacccgttacccgttaccccggtaccggttaccggtaccgtaacgggtaaccgtaacggtaacggtaaacgtaaccgtaagtaccgtaacggtacggtacggtacgtacgtaccgaccgtacgttacgttacgttaccttaccgttaccttcccgttcccgtacccg

SEQ ID NO: 152485 - DNA, 385 bp, Homo sapiens
  misc_feature: GYAE6OF01AX68H.13.53.E09.1.454.CMB.1.raw
  modified_base (362)..(362): a, c, t, g, unknown or other
  misc_feature (362)..(362): n is a, c, g, or t
  modified_base (369)..(385): a, c, t, g, unknown or other
  misc_feature (369)..(385): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacacccggtattctgtctgccctctctccacccccttcctctccacacaggtcagcccaaggccaaccccactcgtcactctcgttccccaccctcctctacgtacgtcgactgagcgggctggacaaggcncatagcnnnnnnnnnnnnnnnnn

SEQ ID NO: 152486 - DNA, 744 bp, Homo sapiens
  misc_feature: GYAE6OF01BRK2X.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctgggctcctgctactctggctccgagtgccagatgtgacatccagatgagccagtctccatccaccctgtctgcgtctctcggagacagggtcaccgatcacttggtcggacaacgtcaagaactagttcggacaacttctttaaattggtatcagtcaagaagtcgacgggcaacgaccccgtaacctcctcgtactcctaaccggtacacgtcctaacgttttcgactaccgtaggtcgggtaactcccgtaagttacgaaacgggtttccaaggttcgggacctaaggttaacgaacgttaccggttaggaaaaccgttacggtaacttttttaaccccactaacccgtagtaccggtaacgggggttccttaaccgacgtacccgtttaaggtaacggttaacgtttttacggacgttaaccgttttacgtttaactttacggtaccgtaaacgttacggttaaccgttttaacccttccccggttacccccgggttaacggtttacccggaaccggtaaccgggtaaacccgtaacgggtaacgaaacggttacgaacggtaccgtaaacgtcggtacgtcgttacgccgtacgtactcgttcgtacttactacttcgttacccgtacc

SEQ ID NO: 152487 - DNA, 690 bp, Homo sapiens
  misc_feature: GYAE6OF01ERQMC.13.53.E09.1.454.CMB.1.raw
  modified_base (526)..(526): a, c, t, g, unknown or other
  misc_feature (526)..(526): n is a, c, g, or t
tcagtcacgtactacacgaccggtgctcgatttagagagagtgtgttgggtttgggggagtcagtctcagtcaggacacagcatggacagtgggggtccccgctcagctccgtggggctcctgctactctggctccgaggtgccagatgtgacatccagatgagccagtctccatccaccctgtctgccgttctcgtcggacgacagggtcaccatcacgttggtcgggcaagtcagaactagttcggactaacttactttaaagttcggtatacacgtacgaagtaaacgtacgacgggtaccgaaccgtacccccgaaccctaccgtagaccttacgtaccgtaccgtactacctactttacgtacgtacgacggtacggtacgtaccctaacgtaccgtaacggttacgtagacggtacgacgtagtacgtacgtacggtaactacgttaacgtttaccctacctacgactaccggtagggtacctacagtccgtagtaactatttcgactaagttactcgtnactaagtacgttaccttccgttaccccgcccgggagtaccgacgacgggtaactaagggtacgaaactcgtaaggaccgtaaacgtcggttggaccggtatacccgtaacgacctttagtccccgtttaacgtccttaacggttcccttccccgcgttaacccg

SEQ ID NO: 152488 - DNA, 668 bp, Homo sapiens
  misc_feature: GYAE6OF01DK9MV.13.53.E09.1.454.CMB.1.raw
  modified_base (102)..(102): a, c, t, g, unknown or other
  misc_feature (102)..(102): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
tcagtcacgtactacacgaccggtgctcgatttagagagagtgtgttgggtttgggggagtcagtctcagtcaggacacagcatggacatgagggtccccgntcagctcctggggctcctgctactctggctccgaggtgccagatgtgacatccagatgacgccagtcctccatcccacccttgtctgtcgtctcgtcggagacgaggtcaccatcacttgcgganaagtcagaacnttcggactaacttacttttaaagttggtactcgtagacaagaagtcgacggacaacggaccccgaacctccgtagtactcgtaacggtacactcctaacgtttcgacactaggtcggactcctagtacgttaaacggtcgtaggtcggtacgtagtacgtacgtacgtacgtaaacgtacgttaccttttacccactacctacggttaaccgaggggttacctaacgaccgtacccgttaggtaacgtttagtttcggtaactactttaacgtttagtacgttaacctaagtacgttaaccgttaccgtttcccggtaccccgttacggtccgggaaccgacgggtaacgtagggtaacgaacgtacgagtacgaatcggtggtactagccaacgtcttaccgtcgttacctactcttcccgtcctaccg

SEQ ID NO: 152489 - DNA, 660 bp, Homo sapiens
  misc_feature: GYAE6OF01AH9Z1.13.53.E09.1.454.CMB.1.raw
  modified_base (647)..(647): a, c, t, g, unknown or other
  misc_feature (647)..(647): n is a, c, g, or t
  modified_base (654)..(654): a, c, t, g, unknown or other
  misc_feature (654)..(654): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagttgacccagtctccatccttcctgtctgcatctgtaggagacagagtcaccatcacttggccgggacaaggtcagggctagttagaaattgtagtttaaggctggtatacagcaagaaaccgagggaaactccccgtaagccttcgttagacttacgtagtggtcgactacgttaccgtaaaggttttaaaacgggtcgggttaccccagtaccgtaaagggttccgagggtaccggtacgtaggtaggtaacttcggttaggacccaaacgtacggttacctttctaactttccgtacaccgtactaccgaaccgcaaccggtctacggtaccgacgtcccgtaagtaagtttacttttgaacctttaacttaacttacgtcttaactaaccgtaagttactactaactaagtttacgtcggtacggtaccggttcgaccggtaacggacgtaaggtacgaaactacgaaacgtacgtgtacgtactanactactngttacg

SEQ ID NO: 152490 - DNA, 673 bp, Homo sapiens
  misc_feature: GYAE6OF01DCA2F.13.53.E09.1.454.CMB.1.raw
  modified_base (198)..(198): a, c, t, g, unknown or other
  misc_feature (198)..(198): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcgganacgagggtcaccatcacttggtcgggcaagtcaagaaccagttggactaacttactttaaattggtatcagcagagtacgaggcaacggcccctaaccgtcctgtactacgtacgtacactcctacgtttgcacgtagtggactccgatacgtagttcgacgtggactagtagtactcgtaggaactaacgttactttttaccccgctaaccgtacgtcggtaacgggttacctacgtacgtacgttaagaacgtttacgtttttacggaccgttaacgttttaaccttagttacgtaactaacgttagttaacccgtttacccgttcccgtacccccgggttacgttacccgggtaccgaaacgggttacccgaagggtacggtaaacgtacgtaaacggtaccgaacgttggtacgacgtacgtcccgtacttacgttcctacgtttcttacctacgttcccttccccgtacc

SEQ ID NO: 152491 - DNA, 675 bp, Homo sapiens
  misc_feature: GYAE6OF01B78YP.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacagttggcaactctttaattggtatcagcagaagtcagggcaacgccccgaacctcctagactcgtacggtacactcctactttgcacaggtcgggactcccatacaaggttcaggtggactagtagatcgtaggtaaactagtaacttttacccctacaccctacgtccgtaacgggggttcctaacgtacggtacccgttaggtaacgttacgtttttacggaccgttaaccttttaaccgttatttacgtacctaaacgtaggttaaccgtttacccttcccgttaccccccgggtacggttacccggtacccgaaacgggaacccggtaacggttacggaaacgtacgtaaacgtaccggtaacgttacggtcggtacgtacggctacccgtaacttaccgttacgttccttaccttaccttcccgttcccccgtacccg

SEQ ID NO: 152492 - DNA, 678 bp, Homo sapiens
  misc_feature: GYAE6OF01DPZ3T.13.53.E09.1.454.CMB.1.raw
  modified_base (106)..(106): a, c, t, g, unknown or other
  misc_feature (106)..(106): n is a, c, g, or t
  modified_base (210)..(210): a, c, t, g, unknown or other
  misc_feature (210)..(210): n is a, c, g, or t
  modified_base (436)..(436): a, c, t, g, unknown or other
  misc_feature (436)..(436): n is a, c, g, or t
tcagtcacgtactacacgaccggtgctcgatttagagagagtgtgttggggtttgggggagtcagtctcagtccaggacacagcatggacatggacgggtccccgntccagctccgtggggctcctgctactctggctcggaggtgccagatgtgacatccagatgacgccagtcctccatccaccctgtctggctctcgacggagacgnggtcaccatcacgtttggacggacaagtcaacgactagttcggactaaacttatttaaagttggatcagacgagtaagcgacggaccaacgtaccccgaacttccaggtactaccgtaacgtactattcctattacgacacggtacgcggactaccgagttacgaacggttcacggtaggacctaagtagtactacgtaaacgtaactacgtttacctttaacccncgaaactcgtacgaacgggttacacgtactacgtagaagttactttacgaccgtttaattacgttacgtactacgtaaacgtagttaaccgtttacccgttccgtaccccggtacggttaccggtaaccggaaccgtaaacggttaacggtaacggaattacccgggaagaccgttaaacggtcgttacggaacgtcaaccctagtaactccgtacttacgttactccttaccgtccctacg

SEQ ID NO: 152493 - DNA, 964 bp, Homo sapiens
  misc_feature: GYAE6OF01CYU0Y.13.53.E09.1.454.CMB.1.raw
  modified_base (894)..(894): a, c, t, g, unknown or other
  misc_feature (894)..(894): n is a, c, g, or t
tcagtcacgtactacacgaccggtgctcgatttagagagagtgtgttgggtttgggggagtcagtctcagtcaggacacagcatggacatggagggtcccccgctcagctccgtggggctcctgctactctggctccgaggtgccagatgtgacatccagatgacgccagtcctccactccaccctgtctcgcgtcctcgtacggagacgacgggtccaaccactcctacgtttcggtaccggggactaaggtccaaggaactagtttcgggaactaacttaacgttttaaagtggttactacgaagcgaaggaagtacgacgggacaaccggaccccgtaacctccgtagacttaccgtaaccggtactacttacccgtacgtttacgaccgtacgtacgggtacgggttaaccctacccgttaacgttaaccggttaaacgggttccgtaaggggtttacggaacggtaacggttaaggtaaccttcggtaaacgggaaaccgtttaacggtttaacccgtttttaacccccaccgttaaaccccgtacgggttaaccgggtaaccgggggtttaaccgttaaaccggtacccggttaacccggtttaaagggttaaacgtttaaccggtttttacggtaaccccgggttttaaactttttaaccggtttaaccgtttttaccggtaaacccgttaaacccgtttaaagggtttaaccccctttttacccccgggtttacccccgggttaaccccccgggtttaccgggtttaccccgggaaacccgggtaaaaccgggtaaaccgggttaaccggggtaacggttaaaaacggaccggttaaaacggacccgggttaaaaggttcgggtttaaccgccggggtttaacccncccgttaaccgttaagttacccgtttacgttacctttaccggtttacccttccccggtttcccctaaccg

SEQ ID NO: 152494 - DNA, 629 bp, Homo sapiens
  misc_feature: GYAE6OF01A1HV0.13.53.E09.1.454.CMB.1.raw
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (610)..(610): a, c, t, g, unknown or other
  misc_feature (610)..(610): n is a, c, g, or t
tcagtcacgtactacacgaccggtgctcgatttagagagagtgtgttgggtttgggggagtcagtctcagtcaggacacgagcatggacatgagggtccccgctcagctcctggggctcctgctactctggctccgaggtgccagatgtgacatccagatgagccagtctccatccaccctgtctgcgtctctcggagacagggtcaccatcacttggtcggcaagtcagacattggacactcttaatggtatnagcagaagtcagggcaacgccccaacctcctagactactacggtacactcctacctttgccaacgtcgtgggaaccttcccattaccgtaaaggttcaaggtcggacctagacgtntcgtagaaccgtagtactttttaacccnctaacctataccgacggggttctaacgtcgtaccctaggaacgttattttcggaccttactttacttatttagacctaacgaggtaacgtttcccttccgtacccccgggtacgttccggaccgtaacgggacgtaaacgggacggtaaacgtcgtaacggacgaaccgttaggcgtacgtcgaccgaccccttattccgtacgtttcctancttccccgttccgtacccg

SEQ ID NO: 152495 - DNA, 683 bp, Homo sapiens
  misc_feature: GYAE6OF01DMBFF.13.53.E09.1.454.CMB.1.raw
  modified_base (156)..(156): a, c, t, g, unknown or other
  misc_feature (156)..(156): n is a, c, g, or t
  modified_base (622)..(622): a, c, t, g, unknown or other
  misc_feature (622)..(622): n is a, c, g, or t
  modified_base (640)..(640): a, c, t, g, unknown or other
  misc_feature (640)..(640): n is a, c, g, or t
tcagtcacgtactacacgaccggtgctcgatttagagagagtgtgttggggtttgggggagtcagtctcagtcaggacacagcatggacatggacgggtccccgctcagctccgtggggctcctgctactctggctccggaggtcgccagatggtnacactccaagtatagacgcctacgtcctcctacctcccgacccttggtctgcgttcctcgtacggaagacgacggtaccacctacgtcgtacgttcggtaccggactaaacggtcgaagtaactggttacgaacttaacgtttaactttaagttagtaatccgaagtacgaagtaacggcgacggaccaaccgtaccccgtaacgtaccgtagtaactaccgtacgtacctactcctacgttacgcaacgtacggtcgtacctaccgtaatacgtacgttagtagtcgtacgtaagtacgtacgtaacgtagtaacttacgttaacctttaccactaccgagttacgacggtacctacgacgtacgtaagtaagttcgttacgtactattactacgtagtaactaacgtagtacctttaccgtccgtaccgtacggtaccgaccggaacggtacgaaggacgtaancgaacgacgtacgtcgtngtacgtcaccgtacgtctcgttactactccttccgtccctacg

SEQ ID NO: 152496 - DNA, 712 bp, Homo sapiens
  misc_feature: GYAE6OF01BAUKK.13.53.E09.1.454.CMB.1.raw
  modified_base (102)..(102): a, c, t, g, unknown or other
  misc_feature (102)..(102): n is a, c, g, or t
  modified_base (248)..(248): a, c, t, g, unknown or other
  misc_feature (248)..(248): n is a, c, g, or t
tcagtcacgtactacacgaccggtgctcgatttagagagagtgtgttgggtttgggggagtcagtctcagtcaggacacagcatggacatgagggtccccgntcagctcctgggctcctgctactctggctccgaggtgccagatgtgacatccagatgagccagtctccatccaccctgtctgcgtctcgtcggagacgagggtcaccatcacgttgtcggacaagtcagaactgttggactaactntttaattggtatactagcagagtcgaggcaacgcccgactcctgtatctacggtacactcctactttgctaacgtacggtaggacctacccgtatacgtaacgttcgagttacggactaggtagactacgtaggaacctagtacctttacccactactacgtacgtaacgggtctaacgacgtaccgtagtaacggttacttttacggaccttaagttaaccgttagtttacgttaacctaacggtttaacgttacccggttttaaccctttacccccggttaacccccggttaacccgggttaccgggtacccggaaacggggtaaccgtaaacggggttaacggtaaacgtaccgtaaacggtcccggtaaaccgttacggtcggtacgttaccgacccgttaaccgtaacttaccgttacgttaccctttaccctacgtttccccctacccggttaacccc

SEQ ID NO: 152497 - DNA, 934 bp, Homo sapiens
  misc_feature: GYAE6OF01AH0QZ.13.53.E09.1.454.CMB.1.raw
  modified_base (139)..(139): a, c, t, g, unknown or other
  misc_feature (139)..(139): n is a, c, g, or t
tcagtcacgtactacacgaccggtgctcgatttagagagagtgtgttgggtttgggggaggtcagtctcagtcaggacacagcatggacatggagggtccccgctcagctccgtggggctcctgctactctggctccgnggtgcagatgtgacatccagatgacgcagtctaccactcccacctgtctcgtcgtctcgtcgggagaccgtacgggtccaaccgtactcgttaccgttcgggtaccgggacctaaacggttacaaacggtaacgtacggtttaccggaacttaaaccgttttaacgttttaaagtttacgggttaactaccgtaacgacgtaaagtaacggtcgaacggggtacctaacccggaccccctaaccgtccgtaagtaccgttaccgtaacggtacgtacccgtaccgttaccgttacggccgtaacggtacggttacgggaaccctacccgtagtttaacggtaaacgggttttccgaagggttccgggtaaccgtaggttaaaccgggttacgttacggtaaacgggttaaccgtttaaccgttttaaccgttttaacccctaccggtaacgtaacggtacccgggtttaacgggttcctaacggtaaccggtacgtttaaacgggtaaacgtttccgtttcgaaacccggttttacttaacgttacggtttacgaaccttaaaccggttacggttaaccctttttaaccccggccccgggttaaaccccgttagggttaccggggttacccggaaacggttacccggtaaggggttaacgtaaacctaacccgggttaacggaacccggttaacgggttccgggaaacgtttcccggaactccggggttaaaccctcggttacccgttttaacggccccttttaactccccggtttaccccgtacttacccccgg

SEQ ID NO: 152498 - DNA, 625 bp, Homo sapiens
  misc_feature: GYAE6OF01BV5RO.13.53.E09.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (406)..(406): a, c, t, g, unknown or other
  misc_feature (406)..(406): n is a, c, g, or t
  modified_base (594)..(594): a, c, t, g, unknown or other
  misc_feature (594)..(594): n is a, c, g, or t
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatcccacctgtcctgtcgtctcgtcgganacgagggtcaccgatcctactttggccggganaagtcagactagttcgactaacttatttaaagtgtatcagcagaagtcgaggaccacggcccctaactccgtgactcgtacgtaactctcctacttcgacacgtagtacggacctaccgatagtacgtcaggtcgtatacgtagtactcgagaacttagttaacctttacccnctactactacggtacgggtacacgacgtacgtagtaagttatttacgacgttacttacgtgttacgactaacgtagttaaccgttaccgttcccgtaccccggtcggttacccggtaaccggtaaccggtacgaacgggtaacgtaacgtacggaacgtcggtagtacggtcggtcacggtcaccgtntacgttacgtcgttctcttccgtccctaccg

SEQ ID NO: 152499 - DNA, 451 bp, Homo sapiens
  misc_feature: GYAE6OF01B1EG8.13.53.E09.1.454.CMB.1.raw
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (409)..(410): a, c, t, g, unknown or other
  misc_feature (409)..(410): n is a, c, g, or t
  modified_base (414)..(451): a, c, t, g, unknown or other
  misc_feature (414)..(451): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtcgaaccctcccagagtactttagacagagaggagggctccacaaccaccccggtattctgtctcgtcccctctcctccctacccccttcctcgtacccacaccaggtccacgacccaaggtcccaaccccactgtccaccgtctccgttccccacccttcctcgttacgtacgtcgtactcggagcgggctcggacaacgggtcgacagtcganantacnnatcnnnnnnnnnnnnnnnnnnnnnnnnnnnnnnnnnnnnnn

SEQ ID NO: 152500 - DNA, 644 bp, Homo sapiens
  misc_feature: GYAE6OF01BG7OO.13.53.E09.1.454.CMB.1.raw
  modified_base (232)..(232): a, c, t, g, unknown or other
  misc_feature (232)..(232): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgaggtcaccatcacttgtcggcaagtcagacnttggcaactactttaattggtatcagcagaagtcaggcaacgccccgaacctcctgactctaacggtcactcctatttgcacagtcggactccatctaaggttcagtcggactagtagactcgtagaactacgttaacttttacccacaacctacgtcgaacgggttcctaacgcgtaccctaggtaacgttagtttgaccgtttaacttacgttactttacgtaccgtaaactacgtaaccgttttacccttaccccgttacccccgggtacggttacccggtaccggaacgggtaaaccgtaacgggtacggtaaagtaccgaacgaccggtaaacgtccggtacgggtactacgtccaaccgtacgttactacgtttcccttacctcctttcccgttcccgttaacccg

SEQ ID NO: 152501 - DNA, 744 bp, Homo sapiens
  misc_feature: GYAE6OF01EV0WI.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccggaggtgccagatgtgacatccagatgagccagttcctccactcccacccttgtctgccgtctcgtcggagacgaggtcaaccatctacgttggtaccgggcaagtcaagaactagttcggacctaaaccttacttttaaaacgttggttaatctaaggaccgtaaggaaacggtacgacggggacccgaaaccggtacccccgaaccttccgtgttaaacccggttacccggtaactacctaccttacgtttacgacgtacgtacggtaggtacctacccgactaacgtaaggttacgtagtacggacgtaggtagtaactcgttacgaacgtaagttacctttaccgtaccgtactacgtacggtacggttaccgtacgtacgtacgtaacgtaacgttacgaaacgtttcgtaacgtacttacgtacttacgtacgtaaccttacgttaccgttacccgttaccgtccccggtaccgttaccggaccgtaacgggtaacgaacggtaacggtaaacgtaccgtaaacgtacgaccgttacgtacggtaccgtacgtaccgtaccgtacgttccgttacgtacctttaccgttaccgtaccgttcccg

SEQ ID NO: 152502 - DNA, 723 bp, Homo sapiens
  misc_feature: GYAE6OF01EXP9E.13.53.E09.1.454.CMB.1.raw
  modified_base (204)..(204): a, c, t, g, unknown or other
  misc_feature (204)..(204): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgccgtctcgtcggagacgngggtcaccactctacgttggtccgggacaagtcaagaactagttcggacctaacttacttttaaagttggtactcagacagaagtcgacgggacaaccgcccccgaacctccgtagtactaccgtaaccggtacactacctactttacgcctacgtaggtcggtacctaccctatacgtaaggttacgagtacggagtaggtagacgtacgtaaggaaaccttacgttaaccttttacccctacgaaccttacgtaccgggtaagggttaccctaaccggtacggtacccgttaggtaaacgttacgtttttacgaccgtttaaacgtttacgttacgtttacgaaccttaaacgtaccgttaaccgtttacccgtttccccggtaacccccggtcggttacccgtaccgaacgggtaaccgaaggtaacggtaaccgaacgtaacggtacgtaccgtaggtacggactcgacctacgtacctgtttaccgtctaaccgtttcctccgttcccgtaccc

SEQ ID NO: 152503 - DNA, 693 bp, Homo sapiens
  misc_feature: GYAE6OF01EN6X5.13.53.E09.1.454.CMB.1.raw
tcagtcacgtactacacgaccggtgctcgatttagagagagtgtgttgggtttgggggagtcagtctcagtcaggacacagcatggacatggagggtccccgctcagctcctggggctcctgctactctggctccgaggtgccagatgtgacatccagatgagcccagtctcccatcccaccctgtctgcgtctcgtcggagacgagggtcaccatctacttgtcgggacaagtcagaactagttgactacttacgtttaaattcggtatcagacaacgaaaccgaaggtaaaccgcccctaaaggccttaccgtgacttaccgtagtatcgactactaccgttaagttacggtaaacgtacggggtacctagtacggtaacggttacgaggtagggtaggtaggactcggtagggtaactagtttaacgttttacctttactacctacgtcaggacctacgcctacggaccacgtaccggtaagtaacgtagttactacggtaactaacttagttaacttacgtcgtacacgtacgtaagttatacgtaacttacttcccgtaccttactacccgtaccgttaccgggaaccggtaaaccggtacgtaaccggtacggtaagggtaaagttaaaccggttaaacgtaccggtacgggttacgacgtacccgaccgttacgtacgtttacccg

SEQ ID NO: 152504 - DNA, 673 bp, Homo sapiens
  misc_feature: GYAE6OF01CGA9L.13.53.E09.1.454.CMB.1.raw
  modified_base (139)..(139): a, c, t, g, unknown or other
  misc_feature (139)..(139): n is a, c, g, or t
  modified_base (561)..(561): a, c, t, g, unknown or other
  misc_feature (561)..(561): n is a, c, g, or t
  modified_base (596)..(596): a, c, t, g, unknown or other
  misc_feature (596)..(596): n is a, c, g, or t
  modified_base (626)..(626): a, c, t, g, unknown or other
  misc_feature (626)..(626): n is a, c, g, or t
  modified_base (635)..(635): a, c, t, g, unknown or other
  misc_feature (635)..(635): n is a, c, g, or t
tcagtcacgtactacacgaccggtgctcgatttagagagagtgtgttgggtttgggggagtcagtctcagtcaggacacagcatggacatgagggtccccgctcagctcctgggctcctgctactctggctccgaggtnccagtatgtgacatccaagatgacgccagtcctaccatccccacccttgtcgtgcgtctcgtacggagacgcggtacacctagtctacttggtccggactaagttcaagtaactgttcggacttaacgttacgtttaaattggtactacgagtacaaggtaacgtacgagggaccaacccggcccctaactccgtgtaacgttaccgtacggtacctaccgttaccgtactttacgaccaacgtaggtacggaccttaccgtagtacgtaacggtcaggtcggactagtacgtcgtacgacggtaacgtactttaccgttacccacgtaacctacgtaccggacggtactacgacgtacctagtagttacttcggattacgttactagtacgtatacgtacgtaccttcgtcccgtacccgnggtacccgtaacggtacgaacggtaaggacgtaanacggaactacggtaacgtcgtcggactacncgaaccttntacgttacgtacttacgtaccgtttccgtcccgtaccg

SEQ ID NO: 152505 - DNA, 786 bp, Homo sapiens
  misc_feature: GYAE6OF01EN5OR.13.53.E09.1.454.CMB.1.raw
  modified_base (106)..(106): a, c, t, g, unknown or other
  misc_feature (106)..(106): n is a, c, g, or t
  modified_base (123)..(123): a, c, t, g, unknown or other
  misc_feature (123)..(123): n is a, c, g, or t
  modified_base (151)..(151): a, c, t, g, unknown or other
  misc_feature (151)..(151): n is a, c, g, or t
  modified_base (718)..(718): a, c, t, g, unknown or other
  misc_feature (718)..(718): n is a, c, g, or t
tcagtcacgtactacacgaccggtgctcgatttagagagagtgtgtttggggtttgggggagtcagtctcagtcaggacacagcatgaacagtggacgggtccccntcagctcgtgggcctcngtctactctggctcggagtcgcagatgnacatcagactgacgccgatcctaccacgtccccacccgttgtccgtcgtccgttccgtccggtacggacacggtacggtacaccattcgtacgttcggggacggacaaggtaccaagaacttagtccggaacttaactttaacgtttttaaagttaggtactacgaacggaacgaaacgggtaaacgtacccgggaaacgggacccaaccccgggtaccccctaaccgttccggtattaacccgttacgtaaccggtacctaactacccgtttattacgactaacgggttacggtaccgaacctaccgtactaacggttacgtcagggtcgagtacagtatcgaaaggtacttaactttccttacccgaccaagtactacggttacgggtactacggtaactacgtaaggtaacgtttatttacggtaaccttaacgtttatcgtttacgtaacctaacgtaaccggttttccgttaccccggtccccggttaacccggtaccggtaccgggtaaccggaacgggtaaacgacggtaacgtaacggtacaacgggtacttaacgggngtaacggtactacccgtaagtacccgtagttaccctgtttccgtaatttccccgttcctaccggtacc

SEQ ID NO: 152506 - DNA, 672 bp, Homo sapiens
  misc_feature: GYAE6OF01BMAYV.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggacaacgtcaagaacagttggactaaacttctttaaattggtatcagcagaagtcgagggtcaacggccccgtaactcctagactactacggtacatcctacttgacacaggtggactcccatactaggttcaggttgactaagtagactctaggaactacgtaccttttaacccactaacctacgtacgtacgggtactaacgacgtacccgtagtaacgttagttttacggacttacttaacttattacgtacaaacgtagttaacctttacccttcccggtacccccggtacggttaccggtaacccggaaaccgggtaacggtaacggggttaacggtaaacgtacgtaaacggtaaacggtaaccgtaggttacgggtaccgttaccgacgtaaccctagttaccgttacggttacctttaccgtacctttacccgttccccgtaccc

SEQ ID NO: 152507 - DNA, 206 bp, Homo sapiens
  misc_feature: GYAE6OF01A60WD.13.53.E09.1.454.CMB.1.raw
  modified_base (95)..(95): a, c, t, g, unknown or other
  misc_feature (95)..(95): n is a, c, g, or t
  modified_base (171)..(171): a, c, t, g, unknown or other
  misc_feature (171)..(171): n is a, c, g, or t
  modified_base (173)..(206): a, c, t, g, unknown or other
  misc_feature (173)..(206): n is a, c, g, or t
tcagtcacgtactacacgaccggtgctcgatttagagagagtgtgttgggtttgggggaagaggaagactgaccggtcccccaggagttcaggtnctgggcacagcggccctgggctgcctggtcaagactacttcctagtacgtgactgagcggctggcaggcgcatagntnnnnnnnnnnnnnnnnnnnnnnnnnnnnnnnnnn

SEQ ID NO: 152508 - DNA, 834 bp, Homo sapiens
  misc_feature: GYAE6OF01DRE9W.13.53.E09.1.454.CMB.1.raw
  modified_base (104)..(104): a, c, t, g, unknown or other
  misc_feature (104)..(104): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
tcagtcacgtactacacgaccggtgctcgatttagagagagtgtgttgggtttgggggagtcagtctcagtcaggacacagcatggacatggacgggtcccccntcagcctccgtggggtcctccgtgctactctcgggcctccggaggtcgaccgagtagttggtagaactactaccgaagtacgtcgacgtcctacgttccctaccaaccgtccctaccgttntccgtgtccgtctcgacggtanacgngtacaactntctacgtgtcganacgtcagactgttacgtactacgtttaattaacgtgtactcgacgtagagtacgacggtagaaccacccgaccctaacttcgtaacgacgttaccgtagtaccctacgttacctacgttacgtaacacggtacggtacgaacccttcgaacgtttcggtaaacgtccgtaaggtcggtaacgtagtaaggtactttacggaaaccgtaacgtttaactttacccctttacgtaactaccgtacgtacggtacggttaaccaggttaacccgttaggtaacgtaagtttacgtttacgttactttaaccggtttaattaccgtttacgtaacccggtttaaactaccgtttaacccggtttacccgttaaccccggtttaccgggtaacccgttttaacccggggacgttaaaacccggggtaccgtaaacggggttaaccgtaaagtaaaccggtaaccggtaacgggtaacgttaacggggtcctaggttaaccccgaagtttacccgtaagtttccccgttacggttacccttacttcccggttcccctacccggttag

SEQ ID NO: 152509 - DNA, 730 bp, Homo sapiens
  misc_feature: GYAE6OF01AQGSJ.13.53.E09.1.454.CMB.1.raw
  modified_base (228)..(228): a, c, t, g, unknown or other
  misc_feature (228)..(228): n is a, c, g, or t
tcagtcacgtactacacgaccggtgctcgatttagagagagtgtgttggggtttgggggagtcagtctcagtcaggacacagcatggacatgagggtcccccgctcagctccgtggggcctcctgctactctggctccggaggtgccagatggtgacatccagatgacgccagtcctccactcccacccttgtctgctatctggtaggagacagacgtacaccatacncttcgaccgaggacgacgtacgagtaactaattaaaccaatttaatttaaagtggtatactacgacgtaaacgaaaccggtaacggtaaaccgtaccccgtaagtcctaccgtagacttacgtagaagtcgactactaacgttaacggttaacggaaacggtccggtacctagtacgtaagttacgaggtaggtagtcggatcggtacggtaagtacgtttacttttaccttacacgtactacgacgtactacggtccgtacgacgtacggaccgttaagtaaacgttacgttaacgttcgaaacctttaaattacgtttactttagtaccgtaagtccgttaataaggtaattaacgtaaccgtttaacccgtcccttaccgggtaaccttaccccgtaacggttacccgggaacgaaaccggtccggtaaagtaccgggtaaaggaaacgttaaaacgttaacccggtagttcgggtaaccgccggtataacgtaacccc

SEQ ID NO: 152510 - DNA, 772 bp, Homo sapiens
  misc_feature: GYAE6OF01DRVD7.13.53.E09.1.454.CMB.1.raw
  modified_base (145)..(145): a, c, t, g, unknown or other
  misc_feature (145)..(145): n is a, c, g, or t
tcagtcacgtactacacgaccggtgctcgatttagagagagtgtgttggggtttgggggagtcagtctcagtcaggacacagcatggacatggagggtccccgctcagctccgtgggctcctgctactctggcctccggaggtcncagatgtcgacactaccagtatagacgctacgtctccactccacctgtctcgctctcgtacggacgacgcggtccactattactacgttcggcgggactaacggtcaagtaactcgttacggacttaaccgtttacgttttaaagttcgggttataccgtaacgacgtaacggtaacggtacggacgggaccgtaaccggtacccccgtaacttcccgtagtacgttaccggtaaccggtacgtacttaccttacgttacgactacgtacggtacggtacctcgtacgttacggacgtacgtaggtcgacgtagtacgactacgtagaacttacgttactttacccactactacgtacggacggtacctacacggtactaggtaacttacgttccgagttaaccgtttactaagttacgtaacctaacgtagggtttacccctttaccgggtaccccggtttaacccgggtaccgggttacccggtaaccggtaaccgggtaccgtaaaagggttccggaaacggttaaccgaacggtacggttactacggggttcccggactccggtaacaccgttccttaccggtttaccgttccttaacccttcccgttccccgtccgtaacgg

SEQ ID NO: 152511 - DNA, 172 bp, Homo sapiens
  misc_feature: GYAE6OF02F7A0Q.13.53.E09.1.454.CMB.1.raw
  modified_base (171)..(172): a, c, t, g, unknown or other
  misc_feature (171)..(172): n is a, c, g, or t
tcagtcacgtactacacgaccggtgctcgatttagagagagtgtgttgggtttggggaagaggaagactgacggtccccaggagttcaggtgctgggcacagcggccctgggctgcctggtcaaggactacttcctagtacgtgactgagcgggctggcaaggcgcatagnn

SEQ ID NO: 152512 - DNA, 509 bp, Homo sapiens
  misc_feature: GYAE6OF02HTMCJ.13.53.E09.1.454.CMB.1.raw
  modified_base (364)..(364): a, c, t, g, unknown or other
  misc_feature (364)..(364): n is a, c, g, or t
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccncaccatcaggggtctacagcctgaagatttgcgtacttactattgtcaacagtagttaccttctccccggacgttcgccgaacggaccaacggtggaaatacaagacgaactgtggctgcaccatctgtcttcactctcccgtcc

SEQ ID NO: 152513 - DNA, 366 bp, Homo sapiens
  misc_feature: GYAE6OF02GNKJX.13.53.E09.1.454.CMB.1.raw
  modified_base (363)..(366): a, c, t, g, unknown or other
  misc_feature (363)..(366): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccatcctcctctagtacgtgactgagcgggctggcaaggcgcatagnnnn

SEQ ID NO: 152514 - DNA, 127 bp, Homo sapiens; identical to SEQ ID NO: 152454
  misc_feature: GYAE6OF02GMGTB.13.53.E09.1.454.CMB.1.raw
  modified_base (127)..(127): a, c, t, g, unknown or other
  misc_feature (127)..(127): n is a, c, g, or t

SEQ ID NO: 152515 - DNA, 571 bp, Homo sapiens
  misc_feature: GYAE6OF02IZZ9G.13.53.E09.1.454.CMB.1.raw
  modified_base (359)..(359): a, c, t, g, unknown or other
  misc_feature (359)..(359): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagcccgaactcctgatctacggtacatccactttgcacagtggatccatcaaggttcagtggcagtagatctggacagattttaccncaccatcagggtctacagcctagaagtattttagcgtaactttaacgtatttgtactaacagtagttaacccttcgttacccccggtacgttccgccgtaacgggacccgaaaggtacgggaaaacgttaccgaaagcccgtaaacgtacggtcgggtacgtcgtacacccgaactctcggttaccttccgtaattccttccccggtaaccc

SEQ ID NO: 152516 - DNA, 510 bp, Homo sapiens
  misc_feature: GYAE6OF02I2UP4.13.53.E09.1.454.CMB.1.raw
tcagtcacgtactacacgaccggtgctcgatttagagagagtgtgttgggtttgggactgaggtgaggaagcctggggcctcagtgaaggtctcctgccaggcctctggatacaccctctttaatcatgacatcaactgggtgcggcaggcccctggacaggggcttgagtggctgggatggatgagagctaacagtggtggcacagagtattcacagaggttccagggcagactcactctgaccagggacactgccacaagcacagcctacttggaactgagcagcctgacatctgacgatacggccatatattactgtgcgagaggctttggattcaggatatatcaacacccgcggcgcgagtcgtcgtctgctgatgcctttgatgtcgtgggccgaagggacgagggtcaccgtctcttcagcctccaccaggcccatcggtcttcccctgccaccctccctaccagacgcaccctcgtcggggccacgacgccggcccgtcggg

SEQ ID NO: 152517 - DNA, 499 bp, Homo sapiens
  misc_feature: GYAE6OF02I6W6E.13.53.E09.1.454.CMB.1.raw
  modified_base (362)..(362): a, c, t, g, unknown or other
  misc_feature (362)..(362): n is a, c, g, or t
tcagtcacgtactacacgaccggtgctcgatttagagagagtgtgttgggtttgggggagtcagtctcagtcaggacacagcatggacatgagggtccccgctcagctcctgggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatcccatcaaggttcagtggcagtagatctaggaacagattttacccncaccatcagcagcctgcagcctagaagatattgacaacatatactgtcagcagtatagataatctccgatcaccttcggaccaaagggacacggactaggaagtaacttaaacggaacttggtacggtactggtacc

SEQ ID NO: 152518 - DNA, 370 bp, Homo sapiens
  misc_feature: GYAE6OF02G0ET0.13.53.E09.1.454.CMB.1.raw
  modified_base (364)..(370): a, c, t, g, unknown or other
  misc_feature (364)..(370): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagccccaaggccaaccccactgtcactctgttcccaccctcctctagtacgtgactgagcgggctggcaaggcgcatagnnnnnnn

SEQ ID NO: 152519 - DNA, 522 bp, Homo sapiens
  misc_feature: GYAE6OF02G0D79.13.53.E09.1.454.CMB.1.raw
  modified_base (389)..(389): a, c, t, g, unknown or other
  misc_feature (389)..(389): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtccatcaagttcagtggaagtgatctggacagtattttacttcacctatcagcagcctgcagcctagaanattattgactaacatattactgtacagcagtatgaattaactcctacccgattccacccgtttacggcccgaaagggaccaacgtactacgggaagtaacgttaaacgtaaccgttggtacggtctagtaccc

SEQ ID NO: 152520 - DNA, 368 bp, Homo sapiens
  misc_feature: GYAE6OF02HAPCJ.13.53.E09.1.454.CMB.1.raw
  modified_base (358)..(358): a, c, t, g, unknown or other
  misc_feature (358)..(358): n is a, c, g, or t
  modified_base (364)..(368): a, c, t, g, unknown or other
  misc_feature (364)..(368): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttcctgtccacacaggtcagcccaaggccaaccccactgtccactctcgttcccaccctcctctagtacgtgactgagcgggctggcaaggcncatagnnnnn

SEQ ID NO: 152521 - DNA, 189 bp, Homo sapiens
  misc_feature: GYAE6OF02GD2WU.13.53.E09.1.454.CMB.1.raw
  modified_base (171)..(189): a, c, t, g, unknown or other
  misc_feature (171)..(189): n is a, c, g, or t
tcagtcacgtactacacgaccggtgctcgatttagagagagtgtgttgggtttgggggaagaggaagactgacggtccccaggagttcaggtgctgggcacagcggcctgggctgcctggtcaaggactacttcctagtacgtgactgagcgggctggcaaggcgcatagnnnnnnnnnnnnnnnnnnn

SEQ ID NO: 152522 - DNA, 177 bp, Homo sapiens
  misc_feature: GYAE6OF02GS22D.13.53.E09.1.454.CMB.1.raw
  modified_base (173)..(177): a, c, t, g, unknown or other
  misc_feature (173)..(177): n is a, c, g, or t
tcagtcacgtactacacgaccggtgctcgatttagagagagtgtgttgggtttgggggaagaggaagactgacggtcccccaggagttcaggtgctgggcacagcggccctgggctgcctggtcaaggactacttcctagtacgtgactgagcgggctggcaaggcgcatagnnnnn

SEQ ID NO: 152523 - DNA, 601 bp, Homo sapiens
  misc_feature: GYAE6OF02G2TE4.13.53.E09.1.454.CMB.1.raw
  modified_base (366)..(366): a, c, t, g, unknown or other
  misc_feature (366)..(366): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggactccatcaaggttcagtggcagtagatctggaacagattttacccncaccatcaggggtctacgagcctgaagtattttgcgtactttactatttgtacaactagtaacgtttacccttccgtaccccccggtacgtttccgggacccgtaaacggggtaacccgtaaagggtacggtaaaacgtaccgaaacgtacggtaaccgtaggttacgggaccgttacggacccgtacccgtaattaccgtcgttccttacctactttcccttaccccgtacccg

SEQ ID NO: 152524 - DNA, 198 bp, Homo sapiens
  misc_feature: GYAE6OF02H64MD.13.53.E09.1.454.CMB.1.raw
  modified_base (176)..(177): a, c, t, g, unknown or other
  misc_feature (176)..(177): n is a, c, g, or t
  modified_base (179)..(198): a, c, t, g, unknown or other
  misc_feature (179)..(198): n is a, c, g, or t
tcagtcacgtactacacgaccggtgctcgatttagagagagtgtgttgggtttggggggaagaggaagactgacggtcccccaggagttcaggtgctgggcacagcggccctgggctgccttggtcaaggtactacttcctagtacgtgactgagcgggctggcaaggcgcatagnnannnnnnnnnnnnnnnnnnnn

SEQ ID NO: 152525 - DNA, 369 bp, Homo sapiens
  misc_feature: GYAE6OF02GFBEV.13.53.E09.1.454.CMB.1.raw
  modified_base (367)..(369): a, c, t, g, unknown or other
  misc_feature (367)..(369): n is a, c, g, or t
tcagtcacgtactacacgaccggtgctcgatttagagagagtgtgttgggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttcctgtccacacaggtcagccccaaggcccaaaccccactgtcactctcgttccccaccctcctctagtacgtgactgagcgggctggcaaggcgcatagnnn

SEQ ID NO: 152526 - DNA, 564 bp, Homo sapiens
  misc_feature: GYAE6OF02FG7EI.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtacccatacgtaaggttcaggcggacaggtggatcgtggacacagtacttcactttctacacctactcacgtcaacgcctgaccacgtccgtaaggaagtttagttttcgaaccttaaacttttaacttacttgtaccttaacgaagtactactaactaattactccgtagggtaccgttcggaccgaacgggaaccgaagggtacgaaactacgaaacgtactggtaggtactcgaccactac

SEQ ID NO: 152527 - DNA, 543 bp, Homo sapiens
  misc_feature: GYAE6OF02HHHD8.13.53.E09.1.454.CMB.1.raw
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagagtcagggcaacgccccgaactctgatctacggtacatccactttgcacagtgggatccatcaaggttcagtgcagtanatctagaacagtactttaccncaccatcgagggtctacagacctgaagtatttcgacgtacttaacttattcgtacaactagtacgtttacctcccgttacccccggtacgttccggaccgtaacgggaccgaaacgggtacggaaagtacgaacgacgaacgtggtggactgccacatctcgtcttctacttctccctacc

SEQ ID NO: 152528 - DNA, 559 bp, Homo sapiens
  misc_feature: GYAE6OF02I1Y48.13.53.E09.1.454.CMB.1.raw
  modified_base (367)..(367): a, c, t, g, unknown or other
  misc_feature (367)..(367): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggactccatcaaggttcagtggcagtagatctaggaacagtattttacccncaccatcaggggtctacagcctagaatattttgacgtactttactatttcgtacaaacgtagtacgttaacccttccgtacccccggtacgtccggtccgaacgggaaccctaagggtacgaaagtaccgaacgtcgaaccgtaggtcggtcgtgccaccactctcgtctttacgacttccgttcccgtacc

SEQ ID NO: 152529 - DNA, 593 bp, Homo sapiens
  misc_feature: GYAE6OF02G66UD.13.53.E09.1.454.CMB.1.raw
  modified_base (314)..(314): a, c, t, g, unknown or other
  misc_feature (314)..(314): n is a, c, g, or t
  modified_base (373)..(373): a, c, t, g, unknown or other
  misc_feature (373)..(373): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattgcaactctttaaatggtatcagcagaagtcagggcaacgccccgaaactcctgatctacggtacatcctactttgccanagtggactccatcaaggttcaggtgactagtagatcgtaggaaacagtacttttacccncaccagtcgaggggttctaacagtaccgttagaagttactttgaccgtaactttactattggtaccaaactcgtaacgttacctttcccgtacccccgggtacgtttccgaccgtaagggacctaaagggtacggaaaacgtcgtaaacgacgtaacgtcggtggacctaggacccacctagttcgtcggttcttaccgtacttcccgttaccccgtacc

SEQ ID NO: 152530 - DNA, 595 bp, Homo sapiens
  misc_feature: GYAE6OF02HVV84.13.53.E09.1.454.CMB.1.raw
  modified_base (367)..(367): a, c, t, g, unknown or other
  misc_feature (367)..(367): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcagagacagggtcaccatcacttgtcgggcaagtcagaacattggcaactctttaaaattggtatcagtcagaagtcagggcaagccccgaacctcctgatctacggtacatccactttgcacagtggatcccatcaagttcagtgcagtagatctagaacagtacttttacccncaccatcgaggggtctaacagcctagaagtattttgacgtaactttactaattgtactaaacgtagtaagtttacccttcccgtacccccggtacgttccggaccgtaacgggacccggtaaaggtacggtaaacgtacgtaacgacggtaaaccgtggttacgggtacgtacgtaccgaaccctacgttaccgttcgttaccgtttacctacttccctttacccccg

SEQ ID NO: 152531 - DNA, 495 bp, Homo sapiens
  misc_feature: GYAE6OF02FN5V4.13.53.E09.1.454.CMB.1.raw
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaatggtatcagcagaaaccaggtaaacgcccctaagctcctgatctacgatgcatccaatttggaaacaggggtcccatacaaggttcagtggaagtggatcgtgggacagtattttacttcacatcagcagcctgcagcctagaanattatgacaaanattactactgcagctagtatgaatatctccgatcaccttcggaccaagggtccacgactggataacttaaacgagtgtcggtactgacc

SEQ ID NO: 152532 - DNA, 175 bp, Homo sapiens; identical to SEQ ID NO: 152461
  misc_feature: GYAE6OF02FNWXS.13.53.E09.1.454.CMB.1.raw
  modified_base (173)..(175): a, c, t, g, unknown or other
  misc_feature (173)..(175): n is a, c, g, or t

SEQ ID NO: 152533 - DNA, 528 bp, Homo sapiens
  misc_feature: GYAE6OF02JK9IF.13.53.E09.1.454.CMB.1.raw
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtcacgtactacacgaccggtgctcgatttagagagagtgtgttgggtttgggggtaggtcgagtctcagtcaggacacagcatggacatgagggtccctgctcagctcctgggactcctgctgctctggctcccagataccagatgtgacatccagatgacccagtctccatcctcctgtctgcatcncttgganacagagtcaccgtcacttgccgggcagtcacgacattaacacttatttagcctggtatcagcagaagccaggganaggtccctaaattattagatactctgctgcgtccgccttgctaatcggggtccagtctcggttcacgttggcggtgactcgtaggacagattcactctcacatccacaacctgctaccctgaacgatgtgaagttatactgtcagaccttatagttagnggtacccgcttntacgttttcgggacggtacggacgtaaggtgaccagaactctaaacggtaactaggttacggccttaggacctaccgtactcg

SEQ ID NO: 152534 - DNA, 667 bp, Homo sapiens
  misc_feature: GYAE6OF02JU92D.13.53.E09.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
tcagtcacgtactacacgaccggtgctcgatttagagagagtgtgttgggtttgggggagtcgagtctcagtcaggacacagcatggacatgagggtccccgctcagctcctgggctcctgctactctggctccgaggtgccagatgtgacatccagatgagccagtctccatccaccctgtctgcgtctctcgganacagggtcaccatcacttgcgggcaagtccagaacnttcggctaactctttaaatggtatcagcagaagtcaggcaacgccccgaactcagactccgtacggtaccactccctaactttncctaacgtggtgggaaccctcccgaactacgtaaacgggttcctaagtcggggtactagtacgattccgaaggaaacctagttaacccgttttcccacaccgtactacgtacggggttacctacggacgtcctacgtaagttacgtttcgacgttacttaccgttattacgtaccaaacgtagtccgttttaaccgtcccgttaccccgggtattaccgggtaccctaacggggtacgttaaccggtaggaaccgttaacaccggtactaaccggtggaacccggtagtaccggctacccgtacttcggtacgtttacccgtacttccggttacccgttaccccgtaccg

SEQ ID NO: 152535 - DNA, 590 bp, Homo sapiens
  misc_feature: GYAE6OF02FKD9Q.13.53.E09.1.454.CMB.1.raw
  modified_base (386)..(386): a, c, t, g, unknown or other
  misc_feature (386)..(386): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgcgggcaagtcagaacattggcaacttctttaaattggtatcagcagaagtcgagggcaacgcccccgaacctccgtagacttcctacggtacacttccactttgacacaggtggactccatacgaaggttcagtggactagtacgatctaggaacagtacttttacccnaacctatacgagggtctacgacaccgtagtaagtgtttgacgttaactttactatttacgtacaactagtacgtttacccttccgtaccccgggtacgttccggaaccgtacgggaaccgtaaggtacggaaactacgaagaccgaagtggtaggcctcggaccaccgtatcgttacgttccttacgtacttccctcccgtacc

SEQ ID NO: 152536 - DNA, 796 bp, Homo sapiens
  misc_feature: GYAE6OF02H1LQH.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagacagggtcaccatcacttgtcgggcaagtcagaacattggactaacttactttaattaggtatcagacaagaagtcgagggtaccaacggaccccgtaacctcctagtactaccgtacggtaacactacctactttacgactacgaggtacggactcctatacgtaaggttcgaggttagactaagtagagtacgtagaacaggttaaccttttaccctactaacctagtacggtacggggtactaacgtacgtacctaggtaaagttacgttttacggaccgtttaactttaaccgtttaacgtttacgtaaaccgtaaacgtaaccggttaaccggttttaaccccgtttaccccggttaccccccggggttaacggttttacccggggtaacccgggtaaaccggggtaaacccggttaaacggggttaaacggtaaacggttaaaccgtaaacgggtaccggtaaaccgttacggggttaccgggttacccggttacggtaacccgttaaccccgttaacgttacccggttttaacggttttaccccgtttaaaccggttacccctttaccccggttttaccccggttaaccccgg

SEQ ID NO: 152537 - DNA, 178 bp, Homo sapiens
  misc_feature: GYAE6OF02IAUD2.13.53.E09.1.454.CMB.1.raw
  modified_base (175)..(178): a, c, t, g, unknown or other
  misc_feature (175)..(178): n is a, c, g, or t
tcagtcacgtactacacgaccggtgctcgatttagagagagtgtgttgggtttggggggaagaggaagactgacggtccccccaggagttcaggtgctgggcacagcggccctgggctgcctggtcaaggactacttcctagtacgtgactgagcgggctggcaaggcgcatagnnnn

SEQ ID NO: 152538 - DNA, 790 bp, Homo sapiens
  misc_feature: GYAE6OF02HN2EQ.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctgggcctcctgctactctggctccggaggtcgccagatgtgacatccagatgagccagtctccatcccacctgtctgcgtctcgtcggagacgacgggtcaccatcactttggcggactaagtcaagaactagttacggacctaaacttaacttttaaagtttacggtaacttacgaacgtaccgaagtaaacgtacggaacgggaccaaaccggaccccccgtaaaccgtcctaggtaacttaccggttaaccggtaacctacgtacctacgttttacgactaacgacgggtacgggaactacccctaagtaccgtaaggttaccgtaaggtcggactaaggtaacgatacgtaggaaactaacgttaccttttacccacaacctagtcggtaacgggtactaacgacgtaccgtaagtaaacgttcgtttacggaccgttaacttaacgttacgtttaacggtaacaaaccgtaaggtttacccgtttaacccttacccggttacccccggtacggtttccggaacccggtaacgggtaacgtaaacggggtaacgtaaaacggtaccgaaacgggtaccgttaacggttacgggtacgggtaccgtacggtacccaaccgttacgttaccttacggtaccgtttacccgtaccgtttaccccgttacccgtaacccg

SEQ ID NO: 152539 - DNA, 778 bp, Homo sapiens
  misc_feature: GYAE6OF02H7PUK.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtcaccatcacttgtcgggacaagtcaagaacagttggacctaacttacttttaaagttcggtaatcgaagactaagaaggtcgaacgggaccaaaccggaccccgtaaccttccgagtactacgtaacggtacacttcctactttacgaccaacgtaggtacggactacccagtacgtaacggttacaggtgacgtagtagactgtacgtaaacgtacgtacttttacccgtacctaaccgtactacggtacgggtacctaacgacgtaccgtaagtaacggttaacgtttcgaccgtttaacgtttaacttacgtttacgtaaccttaaacgtaacggttaacccgtttacccgtttaccccgggtaacccccggttaccgttacccgggtaaacccggtaaaccgggtaaaccgttaaacgggtaaacggtaaaacgtaaccgtaaacggtacccggtaacgttaacgggtcgggttaacccgttcggaaccccgttaacccgtaaccgtttccggttaaccgttcccgtttaacggtttaacccgttccccggtttaccccttaacccgg

SEQ ID NO: 152540 - DNA, 876 bp, Homo sapiens
  misc_feature: GYAE6OF02JH8GA.13.53.E09.1.454.CMB.1.raw
  modified_base (170)..(170): a, c, t, g, unknown or other
  misc_feature (170)..(170): n is a, c, g, or t
tcagtcacgtactacacgaccggtgctcgatttagagagagtgtgttgggtttgggggagtcagtctcagtcaggacacagcatggacatgagggtccccgctcagctccgtgggctcctgctactctggctccgaggtgccagatgtgacatccagatgagccagtccnccactcccaccctgtctcgcgtctcgtacggagacgaggtccacctatctacgtttggccgggactaagtccgaagtaaactagtttcggacttaaaccgttacttttaaagtttaggtacttagaacggtactaaggtaacgttacggaacggtaccgaaacccggtacccccgtaaaccgttcccgtacgtacgttaaccgttaaccggtacctacgttaccccttaacgttttccgaaccgagttaacggtcggtaccttaccgtacgtaacgtaacggttcgtaacggtcggtacgtacggtaaacgtcttacggagtaaaccgtaagttaccttttacccactaaccgtagttacgtacgggtaacttacggcttacgtaagttaacttcgttttaacggaccgttaacgttaaccgtttcgtttaacgttaaaccgtacgttaaaccggttttaccggtttaacccgtttaacccccggtttaccccggtaacgggtttacccgtaacccgggtaaacccgggttaaacccggtaagggttaaaccggtaaaaccggttaccggtaaaacccggtaccgggttaactaacccgggggttacttaccgggtaccgggtaacccccttaaggtaccccgttacggtttaaccgttccccggtttaaacgaccccgttttaaccggttccccccgttaaaccg

SEQ ID NO: 152541 - DNA, 177 bp, Homo sapiens
  misc_feature: GYAE6OF02JCAHZ.13.53.E09.1.454.CMB.1.raw
  modified_base (174)..(177): a, c, t, g, unknown or other
  misc_feature (174)..(177): n is a, c, g, or t
tcagtcacgtactacacgaccggtgctcgatttagagagagtgtgttgggtttgggggaagaggaagactgacggtccccccaggagttcaggtgctgggcacagcggccctgggctgcctggtcaaggactacttcctagtacgtgactgagcgggctggcaaggcgcatagnnnn

SEQ ID NO: 152542 - DNA, 689 bp, Homo sapiens
  misc_feature: GYAE6OF02G68A4.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagtacagggtcaccatccactttcggtaccggggcaaaggtccaagtaacctagttaggacaaccttctttaaaattggtatcagcagaagtacgtagggcaacggtcccccggaacctcctacgtactccgttaacggtactattccctacgttttcgctaacacggtcggtactccccgataccgtaacgttctaaggtcggactacggtacggtaatccgtaggggaaccaggtaacttacgtacctactaccgaactaagtccagcgtacgtcctacggtaccacgtccctaaggttaaacgttcgttttacgaccgttaaactttaactttaccgttacggtaaccctaaacgtacttaacggtttaaactacccgtttaacccgtaccgttaccggtacggtttacccggacggggtacgtaacggtacggtaggaacgtacgtaaccgaacgtacgtacggtacgtccgtacgtacctacgtatccg

SEQ ID NO: 152543 - DNA, 794 bp, Homo sapiens
  misc_feature: GYAE6OF02IL44E.13.53.E09.1.454.CMB.1.raw
  modified_base (197)..(197): a, c, t, g, unknown or other
  misc_feature (197)..(197): n is a, c, g, or t
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcctccctgtctgcatctgtagganacagagtcaccatcctacgttcggaccgggacaacggtcgacgggactaagtttaagaaattggtaagtttaggcgttaggtatcgagacaaacggaaaacccgaaggggtaaaaccgttacccgtaaacggcctttacgttagaacgttaccgttaaggtcgggtagaccgtaacttaccgttaaaaggttttaaaaaacgggtccggggttaaccctaacgttaccggtaaagggtttaccaacgggtccgggtacgtaggttacggtacgttcgtagggacctaacggtacgtaactttacgtactttacctacctaacctaatacgaacgtacgaaccgtcccgtagaccgacggtaccgttaaggttaaacttacgttttacgaaccctttaaacgtttaactttacttaccggttaacttaaacgtaaacgtacttaaccgaaactttaaacgtttaccggtaccgttacggggtaccgttacccgggaaaccggtaaaccggggtaaacctaaacggggtaacgtaaaaccgtaaccgtaaaaaccggtcgttacgggttacgtacccgtaggtacccctaacgttaacg

SEQ ID NO: 152544 - DNA, 909 bp, Homo sapiens
  misc_feature: GYAE6OF02IG8OL.13.53.E09.1.454.CMB.1.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtccaccatcctacgtttgggtcggggacctaaaggtccaagaaactagtttaggaacctaaccttaccgttttaaaaagtttgggttaacttaccgaaggtaccgaaaggtaaggttaccgaaggggtacccaaaaccggtaccccccggtaaacccctttaccccctaggtaacctttaccggttaaacccgggttaaccctaaccgtttaccccgtttaaaccgtttttaccgaacccgtaaaccgtaaccgggttacgggggtaacccttaaccccgtaacgttaaccggtaaacgggttttaccgaagggtacgggtaacctaaagggttaagaaccgtttcggtaaacggtaaaccgtacggtttaacccgtttttaacccctaccgtaacctacgttacgggtaacggggttacctaacgtaaccgtcccgtaaggtaaacgtttacgtttcggaccggttaacctttaacgtagtttacgtaaccgtaaacgtaacggttaaccgtttaccccgttaccccgttacccccgggtacgtttacccggaaccgtaaacgggtaaccctaacgggtaaggtaaacgttaccgaagtaccggtaaacgttcggtacgggtaccgtacggacccgtaacccgtacgttccttaccgggtttaacctttacccggttactttcccccgttacccgtaaccccg

SEQ ID NO: 152545 - DNA, 639 bp, Homo sapiens
  misc_feature: GYAE6OF02F6JCZ.13.53.E09.1.454.CMB.1.raw
  modified_base (102)..(102): a, c, t, g, unknown or other
  misc_feature (102)..(102): n is a, c, g, or t
  modified_base (416)..(416): a, c, t, g, unknown or other
  misc_feature (416)..(416): n is a, c, g, or t
tcagtcacgtactacacgaccggtgctcgatttagagagagtgtgttgggtttgggggagtcagtctcagtcaggacacagcatggacatgagggtccccgntcagctcctggggctcctgctactctggctccgaggtgccagatgtgacatccagatgagccagtctccatccaccctgtctgcgtctctcggagacagggtcaccatccacttgtcgggcaagtcagaacattggcaactctttaaatggtatcagcagaagtcagggcaagccccgaacctcctgactcgtacggtacactccactttgaccacagtgggactcccgatcaacggttcaggtcgctagtagatcgtaggaactagtacttttacccgctaccatcgaggggtactacgagtcctagaacgtnttttacgacgtactttaacgtactttagtacctaaacgtagtacgtttacccgttcccgtacccccgggtacgttttccgggacccgtaaggggaccctaaagggtcggtaaaacgtaccgaacgaccgtaaccgtagggtacggtccgttacggaccgtacccgtaagttacccgttcggtttaccctttacgtaccgtttccctttacccccggtaacccg

SEQ ID NO: 152546 - DNA, 670 bp, Homo sapiens
  misc_feature: GYAE6OF02GOWJC.13.53.E09.1.454.CMB.1.raw
  modified_base (396)..(396): a, c, t, g, unknown or other
  misc_feature (396)..(396): n is a, c, g, or t
tcagtcacgtactacacgaccggtgctcgatttagagagagtgtgttgggtttgggggagtcagtctcagtcaggacacagcatggacatgagggtccccgctcagctccgtggggctcctgctactctggctccgaggtgccagatgtgacatccagatgagccagtctcatccaccctgtctgcgtctctcggagacgagggtcaccatctacttggtcgggacaaggtcagagcagttggacaacttctttaaattggtatcagcagaagtcgagggacaacggccccgaacctcctgatcgtacggtacactccctatttcgcactaggtcggactccatactaacgtcaggtggactagtagactcgtaggaaactagttacttttacccncaacctagtacgtacgggtacctacacgtccgtagtaacgttgtttcgacgttaactttacttagttactacgtaaacgtacggttacgttttacccgttacccgttccccccgggtacgtttacccgggacccggtaaacggggaaacccgtaaacgggtaacgggtaaacgtaggtaacgtaacgtaaccggttcggtacgggtaccgtcggaaccctaccggtacgttaccgttaccggtttctttaacgttaccttaccggtttcccccg

SEQ ID NO: 152547 - DNA, 688 bp, Homo sapiens
  misc_feature: GYAE6OF02H2C7S.13.53.E09.1.454.CMB.1.raw
  modified_base (192)..(192): a, c, t, g, unknown or other
  misc_feature (192)..(192): n is a, c, g, or t
  modified_base (519)..(519): a, c, t, g, unknown or other
  misc_feature (519)..(519): n is a, c, g, or t
tcagtcacgtactacacgaccggtgctcgatttagagagagtgtgttgggtttgggggagtcagtctcagtcaggacacagcatggacatgacgggtcccgctcagctcctgggctcctgctatctgctcggagtgccagatgtgacagtccagatgagccagtctccatccaccgtgtctgcgttctacgnggagacgagggtcactatcactttcggcgggcaagtccgagaaacttagtcgactaattactttaaattggatcgaagcaagtaagcgtaagggcaacggtcccaacttccgagtaactacgtaaccgtcacgtcctaaatttgaaccagtacggttacgaccttaccgtactacgtaacggttcgaaggtttcggaacctaaggttaacggatttacccgaaggtaaaccaccgttttacgtttaccccacgtaacctaagtacgtaacgggtcctaacgacgtacttacgaagttaacttcggactacggttactagtacgttanaaacgtagttaccgttacttacccggtaccgacgtttaccgtaaccgaacgggttaacgaaccgtaaaggtaaactaacgtaacggtacgacgttaacggtcggtaaccgttcgaaccgtaacgtacgtttactacggttacttccttaacgttccttacccgttaacg

SEQ ID NO: 152548 - DNA, 837 bp, Homo sapiens
  misc_feature: GYAE6OF02F8LR0.13.53.E09.1.454.CMB.1.raw
tcagtcacgtactacacgaccggtgctcgatttagagagagtgtgttgggtttgggggagtcagtctcagtcaggacacagcatggacatgagggtcccgctcagctcctggggctcctgctactctggctccgaggtgccagatgtgacactccagatgacgcctagtctccactcccaccctgtctgtccgtctccgtacggagtacgacggggttaccaacccactaccgtacgtttcgggtaccgggaccgtaaggtacgaacgtaaactagttcggacctaaacgtttacttttaaaacgtttggtacttacgaacggactaaacggtaaggttacgaacggggtaccaaacccggtacccccggtaaacccttcccggttaaggtaccgtttacggtaaacccggtaacgttaacgttacccttaccgtttacgcctaacgtaacggggtcggtaacccttaccaagttaaccgtaacgttccgtaggtacgtaggtacgttaagtaacgttcggtaaccggtaaatccggttaacttttacccggactaacctaccggttacggacgggttaccgtagtaccgtacggtaagttaacggttacgttccgtaacgttaaccgtttagtacgtttacgaactaaccgtaggtttacccgttaacccgtttcccggtaccgggttaccgttaccggtaacggtaacggtaaccggaaggtttacgaaacgtaccggtaacggtcggtaacgttccgggtacgtacgtcggttaaccctacggttcctaacggttccgttaaccgttcctaaccgtttccgtacccgttaaccg

SEQ ID NO: 152549 - DNA, 648 bp, Homo sapiens
  misc_feature: GYAE6OF02JXEMA.13.53.E09.1.454.CMB.1.raw
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
tcagtcacgtactacacgaccggtgctcgattagagagagtgtgttgggtttgggggtaggtcgagtctcagtcaggacacagcatggacatgacgggtccccgctcagctccgtgggctcctgctctctgcctccggaggtcgccagatgtagacatccaagagtagacgcctacgtcctccactccctaccgtctgccgtcgtctccggagccagggtcacctattcgacgttgacgggtcaagtccagtaccgattacggctaactcttaaatggtaatcagcagagtcaaggccaagcccccgaatcctgacgtctagtaccccggttaccntcncgtacgcgactacctagtaccgtagaccttaggtgcctaaggtcaggttctacgataccgttaatttaccccgagtaccagtacgtaccggtaacccggtttaaggacttttagcgtaactttaccattacgttaccaacttacggtacttaaccttaccgtacccccgtaacgttacggtaccccgtaaggtacccgtaccggtaaggaacgtacgaaaccggaaactcgaagtaccgtacgtacaaccgttgacctcggtactccctagtccttaccgccctacttaccgtcgtaccttagtaccgg

SEQ ID NO: 152550 - DNA, 518 bp, Homo sapiens
  misc_feature: GYAE6OF01B2HDY.51.67.G01.1.454.CMB.1.raw
  modified_base (315)..(315): a, c, t, g, unknown or other
  misc_feature (315)..(315): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaacgngggacagacccctaaactcctgactcctcgatgcatccaatttaggaacacgggtcccatacgaaggttcagtaggaagtggctcgtgggactagtacttttacttcacatcagcaggctgcagcctagaacgactagttacgactaaacgtattaattacgtcgtaaccaaatagttaatagtattacgtcccgtcccgtac

SEQ ID NO: 152551 - DNA, 490 bp, Homo sapiens
  misc_feature: GYAE6OF01ENTUA.51.67.G01.1.454.CMB.1.raw
  modified_base (315)..(315): a, c, t, g, unknown or other
  misc_feature (315)..(315): n is a, c, g, or t
  modified_base (439)..(439): a, c, t, g, unknown or other
  misc_feature (439)..(439): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacagcccctaaatcctgactcctcgatgcatccactttggaacagggtcccatcaaggttcagtggaagtggctcgtgggacagtattttacttcaccatcagcaggctgcagcctagaanacattcgacaactatattactgtacaacagtatagatacgtcctcccgtcc

SEQ ID NO: 152552 - DNA, 622 bp, Homo sapiens
  misc_feature: GYAE6OF01CQIQZ.51.67.G01.1.454.CMB.1.raw
  modified_base (264)..(264): a, c, t, g, unknown or other
  misc_feature (264)..(264): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctcctgtctgcatctaataggagacagaatcacatcactgccggngagtcgagacattagcatgtatcgtagtaaattggtaactcgaacgaaccgaaaaaaaccgacgggggaaacctaaccggtaacccccttaaaacctccctaggaacttcccgtacgtaatcgactaacttcccgtaaacgtttacgggaaaccgacggggttacccctaagtaccgtaaggttaccgaaggttacggaaggtggctacgtagggaactaagttacttttacttacacgtactacgagtcgaggctacgctacgcctaggaacgtactagttacgactaaacgtattaatttacgtacgtaccgaaacgtagttaatacgtaacttacgttcccgtcccgttacccgg

SEQ ID NO: 152553 - DNA, 592 bp, Homo sapiens
  misc_feature: GYAE6OF01EJB8W.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcaagacaaaaaccagggaacacgaccctaaactcctagactcctgatcgactactaccctacgtttacggaaacgtacggggttacccaagtacgtaaggtttccgaaggttaggaaaggttcgggaccgttacgtaggggaactaacgttaacgtttttacctttccaaccctatacgaacgtcgacggtacttgaccacggacccgtaggaacgtactattcgaactaactaacttaattaacgtcgtacaaacgtaagttatacgtaattacgttccgtcccgtaccg

SEQ ID NO: 152554 - DNA, 581 bp, Homo sapiens
  misc_feature: GYAE6OF01AD668.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggaacaacgacccctaaactcctagactcctcgatcgactactccctaacgtttacgggaaacgtacggggtacccaagtccgaacggtttacaggttagggaaggtcggtacgtcgtaggggaacctaaggttactttttaacctttccaacctactacagtccgaggtctgactacgacccgtagaaacgactagttacgactaaacgtacttattacgtcgtaaccaaatagttaatagaattacgttcccgtcccgtccg
